US012460185B2

(12) United States Patent
Horwitz et al.

(10) Patent No.: US 12,460,185 B2
(45) Date of Patent: Nov. 4, 2025

(54) OPTIMIZED CANNABINOID SYNTHASE POLYPEPTIDES

(71) Applicant: Demetrix, Inc., Berkeley, CA (US)

(72) Inventors: Andrew Horwitz, Oakland, CA (US); Jeff Wong, Berkeley, CA (US); Darren Platt, San Francisco, CA (US); Jeff Ubersax, San Francisco, CA (US)

(73) Assignee: Demetrix, Inc., Berkeley, CA (US)

( * ) Notice: Subject to any disclaimer, the term of this patent is extended or adjusted under 35 U.S.C. 154(b) by 636 days.

(21) Appl. No.: 17/531,123

(22) Filed: Nov. 19, 2021

(65) Prior Publication Data

US 2022/0228130 A1 Jul. 21, 2022

Related U.S. Application Data

(63) Continuation of application No. PCT/US2020/033555, filed on May 19, 2020.

(60) Provisional application No. 62/906,551, filed on Sep. 26, 2019, provisional application No. 62/906,017, filed on Sep. 25, 2019, provisional application No. 62/851,560, filed on May 22, 2019.

(51) Int. Cl.

| | |
|---|---|
| ***C12N 15/52*** | (2006.01) |
| ***C12N 9/02*** | (2006.01) |
| ***C12N 15/81*** | (2006.01) |
| ***C12P 7/22*** | (2006.01) |
| ***C12P 17/06*** | (2006.01) |

(52) U.S. Cl.

CPC ........... *C12N 9/0004* (2013.01); *C12N 15/81* (2013.01); *C12P 7/22* (2013.01); *C12P 17/06* (2013.01); *C12Y 121/03008* (2015.07)

(58) Field of Classification Search

CPC .................................. C12N 15/52; C12P 7/42

See application file for complete search history.

(56) References Cited

U.S. PATENT DOCUMENTS

| | | | | |
|---|---|---|---|---|
| 10,378,020 | B2 * | 8/2019 | Sayre .............. C12Y 111/01006 |
| 2009/0203102 | A1 | 8/2009 | Cervin et al. |
| 2010/0003716 | A1 | 1/2010 | Cervin et al. |
| 2010/0048964 | A1 | 2/2010 | Calabria et al. |

FOREIGN PATENT DOCUMENTS

| | | | |
|---|---|---|---|
| WO | WO-2004/033646 | A2 | 4/2004 |
| WO | WO-2004/033646 | A3 | 4/2004 |
| WO | WO-2009/076676 | A2 | 6/2009 |
| WO | WO-2009/076676 | A3 | 6/2009 |
| WO | WO-2009/132220 | A2 | 10/2009 |
| WO | WO-2009/132220 | A3 | 10/2009 |
| WO | WO-2010/003007 | A2 | 1/2010 |
| WO | WO-2010/003007 | A3 | 1/2010 |

OTHER PUBLICATIONS

Altschul, S.F. et al. (1990). "Basic local alignment search tool," J. Mol. Biol. 215:403-410.

Bennetzen, J.L. et al. (1982). "Codon selection in yeast," J. Biol. Chem. 257:3026-3031.

Bitter, G.A. et al. (1987). "Expression and secretion vectors for yeast," Methods in Enzymology 153:516-544.

Bitter, G.A. (1987). "Heterologous Gene Expression in Yeast," Methods in Enzymology 152:673-684.

Bow, E.W. et al. (2016). "The Structure-Function Relationships of Classical Cannabinoids: CB1/CB2 Modulation," Perspectives in Medicin. Chem. 8:17-39.

Camps, M. et al. (2007). "Genetic constraints on protein evolution," Crit. Rev. Biochem. Mol. Biol. 42:313-326.

Carvalho, A. et al. (2017). "Designing microorganisms for heterologous biosynthesis of cannabinoids," FEMS Yeast Res. 17:fox037, 11 total pages.

ElSohly, M.A. et al. (2005). "Chemical constituents of marijuana: the complex mixture of natural cannabinoids," Life Sci. 78:539-548.

International Search Report mailed on Sep. 14, 2020, for PCT Application No. PCT/US2020/033555, filed on May 19, 2020, 6 pages.

Lithwick, G. et al. (2003). "Hierarchy of sequence-dependent features associated with prokaryotic translation," Genome Research 13:2665-2673.

Onofri, C. et al. (2015). "Sequence heterogeneity of cannabidiolic- and tetrahydrocannabinolic acid-synthase in *Cannabis sativa* L. and its relationship with chemical phenotype," Phytochemistry 116:57-68.

Rothstein, R. (1986). "Chapter 3: Cloning in yeast," in *DNA Cloning*, vol. II, IRL Press, Washington, D.C., 25 total pages.

UniProtKB Accession No. A6P6V9 (CBDAS_CANSA). Cannabidiolic acid synthase (2013), 9 total pages.

Written Opinion of the International Searching Authority mailed on Sep. 14, 2020, for PCT Application No. PCT/US2020/033555, filed on May 19, 2020, 8 pages.

Zirpel, B. et al. (2017). "Engineering yeasts 1-170 as platform organisms for cannabinoid biosynthesis," J. Biotechnol. 259:204-212.

Zirpel, B. et al. (2018). "Elucidation of structure-function relationship of THCA and CBDA synthase from *Cannabis sativa* L," J. Biotechnol. 284:17-26.

* cited by examiner

*Primary Examiner* — Tekchand Saidha

(74) *Attorney, Agent, or Firm* — Foley & Lardner LLP

(57) ABSTRACT

The present disclosure provides engineered variants of a cannabidiolic acid synthase (CBDAS) polypeptide comprising an amino acid sequence of SEQ ID NO:3 with one or more amino acid substitutions, nucleic acids comprising nucleotide sequences encoding said engineered variants, methods of making modified host cells comprising said nucleic acids, modified host cells expressing said engineered variants, methods of producing cannabinoids or cannabinoid derivatives, and methods of screening engineered variants of the cannabidiolic acid synthase (CBDAS) polypeptide.

27 Claims, 17 Drawing Sheets

Specification includes a Sequence Listing.

OPTIMIZED CANNABINOID SYNTHASE POLYPEPTIDES

CROSS-REFERENCE TO RELATED APPLICATIONS

This application is a continuation of International Application No. PCT/US2020/033555, filed May 19, 2020, which claims the benefit of U.S. Provisional Application No. 62/851,560, filed May 22, 2019, U.S. Provisional Application No. 62/906,017, filed Sep. 25, 2019, and U.S. Provisional Application No. 62/906,551, filed Sep. 26, 2019, the content of each of which is incorporated herein by reference in its entirety.

DESCRIPTION OF THE TEXT FILE SUBMITTED ELECTRONICALLY

The contents of the text file submitted electronically herewith are incorporate herein by reference in their entirety: a computer readable format copy of the sequence listing (filename: DEMT-004_03US_SeqList_ST25.txt, date recorded: Nov. 19, 2021, file size 924 kilobytes).

BACKGROUND

Plants from the genus *Cannabis* have been used by humans for their medicinal properties for thousands of years. In modern times, the bioactive effects of *Cannabis* are attributed to a class of compounds termed “cannabinoids,” of which there are hundreds of structural analogs including tetrahydrocannabinol (THC) and cannabidiol (CBD). These molecules and preparations of *Cannabis* material have recently found application as therapeutics for chronic pain, multiple sclerosis, cancer-associated nausea and vomiting, weight loss, appetite loss, spasticity, seizures, and other conditions.

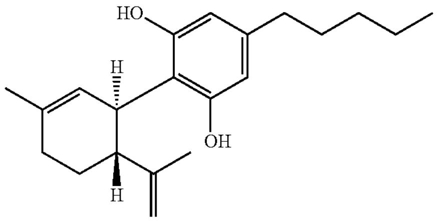

Cannabidiol/CBD

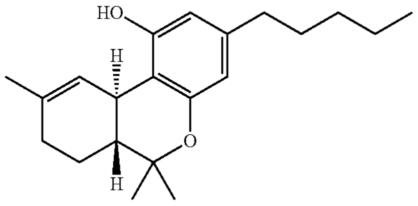

Tetrahydrocannabinol/THF/Dronabinol/Marinol

The physiological effects of certain cannabinoids are thought to be mediated by their interaction with two cellular receptors found in humans and other animals. Cannabinoid receptor type 1 (CB1) is common in the brain, the reproductive system, and the eye. Cannabinoid receptor type 2 (CB2) is common in the immune system and mediates therapeutic effects related to inflammation in animal models. The discovery of cannabinoid receptors and their interactions with plant-derived cannabinoids predated the identification of endogenous ligands.

Besides THC and CBD, hundreds of other cannabinoids have been identified in *Cannabis*. However, many of these compounds exist at low levels and alongside more abundant cannabinoids, making it difficult to obtain pure samples from plants to study their therapeutic potential. Similarly, methods of chemically synthesizing these types of products have been cumbersome and costly, and tend to produce insufficient yield. Accordingly, additional methods of making pure cannabinoids or cannabinoid derivatives are needed.

One possible method is production via fermentation of engineered microbes, such as yeast. By engineering production of the relevant plant enzymes in microbes, it may be possible to achieve conversion of various feedstocks into a range of cannabinoids, potentially at much lower cost and with much higher purity than what is available from the plant. A key challenge to this effort is the difficulty of expressing plant enzymes in the microbe, particularly secreted enzymes such as the cannabinoid synthases, which must successfully traverse the microbe’s secretory pathway to fold and function properly. Engineered variants of cannabinoid synthases, modified host cells, and new methods are needed to address these challenges.

SUMMARY

The present disclosure provides engineered variants of a cannabidiolic acid synthase (CBDAS) polypeptide comprising an amino acid sequence of SEQ ID NO:3 with one or more amino acid substitutions, nucleic acids comprising nucleotide sequences encoding said engineered variants, methods of making modified host cells comprising said nucleic acids, modified host cells for producing cannabinoids or cannabinoid derivatives, methods of producing cannabinoids or cannabinoid derivatives, and methods of screening engineered variants of the cannabidiolic acid synthase (CBDAS) polypeptide. The engineered variants of the disclosure may be useful for producing cannabinoids or cannabinoid derivatives (e.g., non-naturally occurring cannabinoids). The modified host cells of the disclosure may be useful for producing cannabinoids or cannabinoid derivatives (e.g., non-naturally occurring cannabinoids) and/or for expressing engineered variants of the disclosure. The disclosure also provides for modified host cells for expressing the engineered variants of the disclosure. Additionally, the disclosure provides for preparation of engineered variants of the disclosure.

An aspect of the disclosure relates to an engineered variant of a cannabidiolic acid synthase (CBDAS) polypeptide comprising an amino acid sequence of SEQ ID NO:3 with one or more amino acid substitutions. In some embodiments, the engineered variant comprises an amino acid sequence with at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to SEQ ID NO:3. In some embodiments, the engineered variant comprises an amino acid sequence with 85%, 86%, 87%, 88%, 89%, 90%, 91%, 92%, 93%, 94%, 95%, 96%, 97%, 98%, or 99% sequence identity to SEQ ID NO:3. In some embodiments, the engineered variant comprises at least one amino acid substitution in a signal polypeptide, a flavin adenine dinucleotide (FAD) binding domain, a berberine bridge enzyme (BBE) domain, or a combination of the foregoing. In some embodiments, the engineered variant comprises substitution of at least one surface exposed amino acid.

In some embodiments, the engineered variant comprises at least one amino acid substitution at an amino acid selected from the group consisting of C12, F17, F18, S20, R31, N33, P43, L49, K50, L51, Q55, N56, N57, L59, M61, S62, V63, S66, L71, S75, I97, L98, S100, V103, T109, Q124, V125, I129, L132, S137, H143, V149, W161, K165, E167, N168, S170, L171, A172, Y175, C180, A181, N196, H208, A235, A250, M256, K260, L268, H309, T310, F316, L326, G378, K389, E406, S428, L439, N466, K474, Y499, N527, P538, R541, H542, R543, and H544. In some embodiments, the engineered variant comprises at least one amino acid substitution at an amino acid selected from the group consisting of C12, F17, F18, S20, R31, N33, P43, L49, K50, L51, Q55, N56, N57, L59, M61, S62, V63, S66, L71, S75, I97, L98, S100, V103, T109, Q124, V125, I129, L132, S137, H143, V149, W161, K165, E167, N168, S170, L171, A172, Y175, C180, A181, N196, H208, A235, A250, M256, K260, L268, H309, T310, F316, L326, G378, K389, E406, M412, L415, S428, L439, I445, N466, K474, Y499, N527, P538, R541, H542, R543, and H544. In some embodiments, the engineered variant comprises at least one amino acid substitution at an amino acid selected from the group consisting of R31, P43, L49, K50, L51, Q55, N56, N57, M61, S62, L71, I97, S100, V103, T109, Q124, V125, I129, L132, S137, H143, V149, W161, K165, E167, N168, S170, L171, A172, Y175, C180, A181, N196, H208, A235, A250, M256, K260, L268, H309, T310, F316, L326, G378, K389, S428, L439, N466, K474, Y499, N527, P538, R541, H542, R543, and H544. In some embodiments, the engineered variant comprises at least one amino acid substitution at an amino acid selected from the group consisting of L49, K50, N56, N57, V125, L132, V149, W161, K165, S170, L171, A172, N196, A235, K260, L268, T310, F316, L326, G378, S428, Y499, N527, H543, and H544. In some embodiments, the engineered variant comprises at least one amino acid substitution at an amino acid selected from the group consisting of R541, H542, R543, and H544. In some embodiments, the engineered variant comprises at least one amino acid substitution at an amino acid selected from the group consisting of R31, N57, M61, L71, S170, A172, Y175, N196, H208, A235, K260, G378, K389, and R543. In some embodiments, the engineered variant comprises at least one amino acid substitution at an amino acid selected from the group consisting of N57, S170, A172, N196, A235, K260, and G378. In some embodiments, the engineered variant comprises at least one amino acid substitution at an amino acid selected from the group consisting of M412, L415, and I445. In some embodiments, the engineered variant comprises an amino acid substitution at amino acid I445. In some embodiments, the engineered variant comprises at least one amino acid substitution at an amino acid selected from the group consisting of M61, G378, and K389. In some embodiments, the engineered variant comprises amino acid substitutions at amino acids M61 and G378. In some embodiments, the engineered variant comprises amino acid substitutions at amino acids M61 and K389. In some embodiments, the engineered variant comprises amino acid substitutions at amino acids G378 and K389. In some embodiments, the engineered variant comprises amino acid substitutions at amino acids M61, G378, and K389.

In some embodiments, the engineered variant comprises at least one amino acid substitution selected from the group consisting of C12F, F17M, F18T, F18W, S20G, R31Q, N33K, P43E, L49E, L49K, L49Q, K50T, L51I, Q55E, Q55P, N56E, N57D, N57E, L59E, M61H, M61S, M61W, S62N, S62Q, V63M, S66D, L71A, L71H, L71Q, S75D, S75E, I97V, L98V, S100A, V103A, V103F, T109V, Q124D, Q124E, Q124N, V125E, V125Q, I129V, L132M, S137G, H143D, V149I, W161K, W161R, W161Y, K165A, E167P, N168S, S170T, L171I, A172V, Y175F, C180A, A181V, N196Q, N196T, N196V, H208T, A235P, A250T, M256V, K260C, K260W, L268I, H309V, T310A, T310C, F316Y, L326I, G378T, G378S, K389E, E406K, S428L, L439M, N466D, K474S, Y499M, Y499V, N527E, P538T, R541E, R541V, H542V, R543A, R543E, H544E, and H544D. In some embodiments, the engineered variant comprises at least one amino acid substitution selected from the group consisting of C12F, F17M, F18T, F18W, S20G, R31Q, N33K, P43E, L49E, L49K, L49Q, K50T, L51I, Q55E, Q55P, N56E, N57D, N57E, L59E, M61H, M61S, M61W, S62N, S62Q, V63M, S66D, L71A, L71H, L71Q, S75D, S75E, I97V, L98V, S100A, V103A, V103F, T109V, Q124D, Q124E, Q124N, V125E, V125Q, I129V, L132M, S137G, H143D, V149I, W161K, W161R, W161Y, K165A, E167P, N168S, S170T, L171I, A172V, Y175F, C180A, A181V, N196Q, N196T, N196V, H208T, A235P, A250T, M256V, K260C, K260W, L268I, H309V, T310A, T310C, F316Y, L326I, G378T, G378S, K389E, E406K, M412Q, L415M, S428L, L439M, I445M, N466D, K474S, Y499M, Y499V, N527E, P538T, R541E, R541V, H542V, R543A, R543E, H544E, and H544D. In some embodiments, the engineered variant comprises at least one amino acid substitution selected from the group consisting of R31Q, P43E, L49E, L49K, L49Q, K50T, L51I, Q55E, Q55P, N56E, N57D, M61H, M61S, M61W, S62Q, L71A, L71Q, I97V, S100A, V103A, V103F, T109V, Q124D, Q124E, Q124N, V125E, V125Q, I129V, L132M, S137G, H143D, V149I, W161K, W161R, W161Y, K165A, E167P, N168S, S170T, L171I, A172V, Y175F, C180A, A181V, N196Q, N196T, N196V, H208T, A235P, A250T, M256V, K260C, K260W, L268I, H309V, T310A, T310C, F316Y, L326I, G378T, G378S, K389E, S428L, L439M, N466D, K474S, Y499M, Y499V, N527E, P538T, R541E, R541V, H542V, R543A, R543E, H544E, and H544D. In some embodiments, the engineered variant comprises at least one amino acid substitution selected from the group consisting of L49E, L49Q, K50T, N56E, N57D, V125E, L132M, V149I, W161R, K165A, S170T, L171I, A172V, N196Q, N196T, N196V, A235P, K260W, K260C, L268I, T310A, T310C, F316Y, L326I, G378T, S428L, Y499M, Y499V, N527E, H543E, and H544E. In some embodiments, the engineered variant comprises at least one amino acid substitution selected from the group consisting of R541E, R541V, H542V, R543A, R543E, H544E, and H544D. In some embodiments, the engineered variant comprises at least one amino acid substitution selected from the group consisting of R31Q, N57D, M61W, L71H, S170T, A172V, Y175F, N196V, H208T, A235P, K260W, G378T, K389E, and R543E. In some embodiments, the engineered variant comprises at least one amino acid substitution selected from the group consisting of N57D, S170T, A172V, N196V, A235P, K260W, and G378T. In some embodiments, the engineered variant comprises at least one amino acid substitution selected from the group consisting of M412Q, L415M, and I445M. In some embodiments, the engineered variant comprises amino acid substitution I445M. In some embodiments, the engineered variant comprises at least one amino acid substitution selected from the group consisting of M61W, G378T, and K389E. In some embodiments, the engineered variant comprises amino acid substitutions M61W and G378T. In some embodiments, the engineered variant comprises amino acid substitutions M61W and K389E. In some embodiments, the engineered variant comprises amino acid substitutions G378T and K389E. In some embodiments, the engineered variant comprises amino acid substitutions M61W, G378T, and K389E.

In some embodiments, the engineered variant comprises an amino acid sequence selected from the group consisting of SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, and SEQ ID NO:234.

In some embodiments, the engineered variant comprises an amino acid sequence selected from the group consisting of SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:300, SEQ ID NO:302, and SEQ ID NO:304.

In some embodiments, the engineered variant comprises an amino acid sequence selected from the group consisting of SEQ ID NO:60, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:88, SEQ ID NO:90, SEQ ID NO:92, SEQ ID NO:96, SEQ ID NO:102, SEQ ID NO:106, SEQ ID NO:112, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, and SEQ ID NO:234.

In some embodiments, the engineered variant comprises an amino acid sequence selected from the group consisting of SEQ ID NO:66, SEQ ID NO:70, SEQ ID NO:72, SEQ ID NO:80, SEQ ID NO:82, SEQ ID NO:130, SEQ ID NO:136, SEQ ID NO:142, SEQ ID NO:146, SEQ ID NO:150, SEQ ID NO:156, SEQ ID NO:158, SEQ ID NO:160, SEQ ID NO:168, SEQ ID NO:170, SEQ ID NO:172, SEQ ID NO:176, SEQ ID NO:182, SEQ ID NO:184, SEQ ID NO:186, SEQ ID NO:190, SEQ ID NO:192, SEQ ID NO:194, SEQ ID NO:196, SEQ ID NO:198, SEQ ID NO:206, SEQ ID NO:214, SEQ ID NO:216, SEQ ID NO:218, SEQ ID NO:230, and SEQ ID NO:232.

In some embodiments, the engineered variant comprises an amino acid sequence selected from the group consisting of SEQ ID NO:222, SEQ ID NO:224, SEQ ID NO:226, SEQ ID NO:228, SEQ ID NO:230, SEQ ID NO:232, and SEQ ID NO:234.

In some embodiments, the engineered variant comprises an amino acid sequence selected from the group consisting of SEQ ID NO:60, SEQ ID NO:82, SEQ ID NO:92, SEQ ID NO:104, SEQ ID NO:156, SEQ ID NO:160, SEQ ID NO:162, SEQ ID NO:172, SEQ ID NO:174, SEQ ID NO:176, SEQ ID NO:184, SEQ ID NO:198, SEQ ID NO:202, and SEQ ID NO:230.

In some embodiments, the engineered variant comprises an amino acid sequence selected from the group consisting of SEQ ID NO:82, SEQ ID NO:156, SEQ ID NO:160, SEQ ID NO:172, SEQ ID NO:176, SEQ ID NO:184, and SEQ ID NO:198.

In some embodiments, the engineered variant comprises an amino acid sequence selected from the group consisting of SEQ ID NO:300, SEQ ID NO:302, and SEQ ID NO:304. In some embodiments, the engineered variant comprises an amino acid sequence of SEQ ID NO:300.

In some embodiments, the engineered variant comprises an amino acid sequence selected from the group consisting of SEQ ID NO:314, SEQ ID NO:316, SEQ ID NO:318, and SEQ ID NO:320. In some embodiments, the engineered variant comprises an amino acid sequence of SEQ ID NO:314. In some embodiments, the engineered variant comprises an amino acid sequence of SEQ ID NO:316. In some embodiments, the engineered variant comprises an amino acid sequence of SEQ ID NO:318. In some embodiments, the engineered variant comprises an amino acid sequence of SEQ ID NO:320.

In some embodiments, the engineered variant comprises an amino acid sequence of SEQ ID NO:3 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, or at least 30 amino acid substitutions. In some embodiments, the engineered variant comprises an amino acid sequence of SEQ ID NO:3 with 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 amino acid substitutions.

In some embodiments, the engineered variant comprises at least one immutable amino acid in a flavin adenine dinucleotide (FAD) binding domain, a berberine bridge enzyme (BBE) domain, or a combination of the foregoing. In some embodiments, the engineered variant comprises at least 1, at least 2, at least 3, at least 4, at least 5, at least 6, at least 7, at least 8, at least 9, at least 10, at least 11, at least 12, at least 13, at least 14, or at least 15 immutable amino acids in the FAD binding domain. In some embodiments, the engineered variant comprises at least 1, at least 2, at least 3, at least 4, at least 5, at least 6, at least 7, at least 8, at least 9, at least 10, at least 11, at least 12, at least 13, at least 14, or at least 15 immutable amino acids in the BBE domain.

In some embodiments, the engineered variant comprises at least one immutable amino acid selected from the group consisting of A28, F34, L35, C37, L64, N70, P87, I93, C99, R108, R110, G112, E117, G118, 5120, P126, F127, D131, D141, W148, G152, A153, L155, G156, E157, Y159, Y160, N163, A173, G174, C176, P177, T178, V179, G182, G183, H184, F185, G187, G188, G189, Y190, G191, P192, L193, R195, A201, D202, I205, D206, V210, G214, G223, D225, L226, F227, W228, R231, G234, 5237, F238, G239, K245, I246, L248, V251, V259, Q276, F312, 5313, L323, C341, F352, 5354, F380, K381, I382, K383, D385, Y386, I391, G419, M422, I425, I430, P431, P433, H434, R435, G437, Y440, W443, Y444, I464, Y465, M468, T469, Y471, V472, P476, R484, N498, A502, N513, F514, K521, N528, F529, E533, Q534, and S535. In some embodiments, the engineered variant comprises at least one immutable amino acid selected from the group consisting of C37, N70, I93, C99, E117, 5120, F127, D131, G156, E157, Y159, G174, C176, G182, G183, F185, G187, G188, G189, Y190, G191, P192, R195, D202, D206, G214, W228, G234, F238, L248, Q276, 5313, L323, S354, K381, K383, D385, G419, M422, R435, Y440, W443, Y444, Y471, P476, N513, F514, N528, and Q534. In some embodiments, the engineered variant comprises at least one immutable amino acid selected from the group consisting of A28, F34, L35, C37, L64, N70, P87, I93, C99, R108, R110, G112, E117, G118, 5120, P126, F127, D131, D141, W148, G152, A153, L155, G156, E157, Y159, Y160, N163, A173, G174, C176, P177, T178, V179, G182, G183, H184, F185, G187, G188, G189, Y190, G191, P192, L193, R195, A201, D202, I205, D206, V210, G214, G223, D225, L226, F227, W228, R231, G234, 5237, F238, G239, K245, I246, L248, V251, V259, Q276, F312, 5313, L323, C341, F352, S354, F380, K381, I382, K383, D385, Y386, 1391, M412, L415, G419, M422, I425, I430, P431, P433, H434, R435, G437, Y440, W443, Y444, I445, I464, Y465, M468, T469, Y471, V472, P476, R484, N498, A502, N513, F514, K521, N528, F529, E533, Q534, and S535.

In some embodiments, the engineered variant comprises at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, or at least 25 immutable amino acids.

In some embodiments, the engineered variant produces cannabidiolic acid (CBDA) from cannabigerolic acid (CBGA) in a greater amount, as measured in mg/L or mM, than an amount of CBDA produced from CBGA by a cannabidiolic acid synthase polypeptide having an amino acid sequence of SEQ ID NO:3 under similar conditions for the same length of time. In some embodiments, the engineered variant produces cannabidiolic acid (CBDA) from cannabigerolic acid (CBGA) in an amount, as measured in mg/L or mM, at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% greater than an amount of CBDA produced from CBGA by a cannabidiolic acid synthase polypeptide having an amino acid sequence of SEQ ID NO:3 under similar conditions for the same length of time.

In some embodiments, the engineered variant produces cannabidiolic acid (CBDA) from cannabigerolic acid (CBGA) in an increased ratio of CBDA over tetrahydrocannabinolic acid (THCA) compared to that produced by a cannabidiolic acid synthase polypeptide having an amino acid sequence of SEQ ID NO:3 under similar conditions for the same length of time. In some embodiments, the engineered variant produces CBDA from CBGA in a ratio of CBDA over THCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

In some embodiments, the engineered variant produces cannabidiolic acid (CBDA) from cannabigerolic acid (CBGA) in an increased ratio of CBDA over cannabichromenic acid (CBCA) compared to that produced by a cannabidiolic acid synthase polypeptide having an amino acid sequence of SEQ ID NO:3 under similar conditions for the same length of time. In some embodiments, the engineered variant produces CBDA from CBGA in a ratio of CBDA over CBCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

In some embodiments, the engineered variant comprises a truncation at an N-terminus, at a C-terminus, or at both the N- and C-termini. In some embodiments, the truncated engineered variant comprises a signal polypeptide or a membrane anchor. In some embodiments, the engineered variant lacks a native signal polypeptide. In some embodiments, the engineered variant comprises a truncation of at least 1, at least 2, at least 3, at least 4, at least 5, at least 6, at least 7, at least 8, at least 9, or at least 10 amino acids at the C-terminus. In some embodiments, the engineered variant comprises a truncation of 1, 2, 3, 4, 5, 6, 7, 8, 9, or 10 amino acids at the C-terminus.

Another aspect of the disclosure relates to a nucleic acid comprising a nucleotide sequence encoding an engineered variant of the disclosure. In some embodiments, the nucleotide sequence encoding the engineered variant of the disclosure is selected from the group consisting of SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, and SEQ ID NO:233. In some embodiments of the nucleic acids of the disclosure, the nucleotide sequence is codon-optimized.

In some embodiments, the nucleotide sequence encoding the engineered variant of the disclosure is selected from the group consisting of SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:299, SEQ ID NO:301, and SEQ ID NO:303. In some embodiments of the nucleic acids of the disclosure, the nucleotide sequence is codon-optimized.

In some embodiments, the nucleotide sequence encoding the engineered variant of the disclosure is selected from the group consisting of SEQ ID NO:313, SEQ ID NO:315, SEQ ID NO:317, and SEQ ID NO:319. In some embodiments of the nucleic acids of the disclosure, the nucleotide sequence is codon-optimized.

An aspect of the disclosure relates to a method of making a modified host cell for producing a cannabinoid or a cannabinoid derivative, the method comprising introducing one or more nucleic acids comprising a nucleotide sequence encoding an engineered variant of the disclosure into a host cell.

Another aspect of the disclosure relates to a vector comprising one or more nucleic acids comprising a nucleotide sequence encoding an engineered variant of the disclosure.

An aspect of the disclosure relates to a method of making a modified host cell for producing a cannabinoid or a cannabinoid derivative, the method comprising introducing one or more vectors comprising one or more nucleic acids comprising a nucleotide sequence encoding an engineered variant of the disclosure into a host cell.

Another aspect of the disclosure relates to a modified host cell for producing a cannabinoid or a cannabinoid derivative, wherein the modified host cell comprises one or more nucleic acids comprising a nucleotide sequence encoding an engineered variant of the disclosure.

In some embodiments of the disclosure, the modified host cell comprises one or more heterologous nucleic acids comprising a nucleotide sequence encoding a geranyl pyrophosphate:olivetolic acid geranyltransferase (GOT) polypeptide. In certain such embodiments, the GOT polypeptide comprises an amino acid sequence having at least 85% sequence identity to SEQ ID NO:17. In some embodiments, the modified host cell comprises two or more heterologous nucleic acids comprising the nucleotide sequence encoding the GOT polypeptide.

In some embodiments of the disclosure, the modified host cell comprises one or more heterologous nucleic acids comprising a nucleotide sequence encoding a NphB polypeptide. In certain such embodiments, the NphB polypeptide comprises an amino acid sequence having at least 85% sequence identity to SEQ ID NO:294.

In some embodiments of the disclosure, the modified host cell comprises one or more heterologous nucleic acids comprising a nucleotide sequence encoding a tetraketide synthase (TKS) polypeptide and one or more heterologous nucleic acids comprising a nucleotide sequence encoding an olivetolic acid cyclase (OAC) polypeptide. In certain such embodiments, the TKS polypeptide comprises an amino acid sequence having at least 85% sequence identity to SEQ ID NO:19. In some embodiments, the modified host cell comprises three or more heterologous nucleic acids comprising a nucleotide sequence encoding a TKS polypeptide. In some embodiments, the OAC polypeptide comprises an amino acid sequence having at least 85% sequence identity to SEQ ID NO:21 or SEQ ID NO:48. In some embodiments, the modified host cell comprises three or more heterologous nucleic acids comprising a nucleotide sequence encoding an OAC polypeptide.

In some embodiments of the disclosure, the modified host cell comprises one or more heterologous nucleic acids comprising a nucleotide sequence encoding an acyl-activating enzyme (AAE) polypeptide. In certain such embodiments, the AAE polypeptide comprises an amino acid sequence having at least 85% sequence identity to SEQ ID NO:23. In some embodiments, the modified host cell comprises two or more heterologous nucleic acids comprising a nucleotide sequence encoding an AAE polypeptide.

In some embodiments of the disclosure, the modified host cell comprises one or more of the following: a) one or more heterologous nucleic acids comprising a nucleotide sequence encoding a HMG-CoA synthase (HMGS) polypeptide; b) one or more heterologous nucleic acids comprising a nucleotide sequence encoding a truncated 3-hydroxy-3-methyl-glutaryl-CoA reductase (tHMGR) polypeptide; c) one or more heterologous nucleic acids comprising a nucleotide sequence encoding a mevalonate kinase (MK) polypeptide; d) one or more heterologous nucleic acids comprising a nucleotide sequence encoding a phosphomevalonate kinase (PMK) polypeptide; e) one or more heterologous nucleic acids comprising a nucleotide sequence encoding a mevalonate pyrophosphate decarboxylase (MVD1) polypeptide; or f) one or more heterologous nucleic acids comprising a nucleotide sequence encoding a isopentenyl diphosphate isomerase (IDI1) polypeptide. In some embodiments, the IDI1 polypeptide comprises an amino acid sequence having at least 85% sequence identity to SEQ ID NO:25. In some embodiments, the tHMGR polypeptide comprises an amino acid sequence having at least 85% sequence identity to SEQ ID NO:27. In some embodiments, the HMGS polypeptide comprises an amino acid sequence having at least 85% sequence identity to SEQ ID NO:29. In some embodiments, the MK polypeptide comprises an amino acid sequence having at least 85% sequence identity to SEQ ID NO:39. In some embodiments, the PMK polypeptide comprises an amino acid sequence having at least 85% sequence identity to SEQ ID NO:37. In some embodiments, the MVD1 polypeptide comprises an amino acid sequence having at least 85% sequence identity to SEQ ID NO:33.

In some embodiments of the disclosure, the modified host cell comprises one or more heterologous nucleic acids comprising a nucleotide sequence encoding an acetoacetyl-CoA thiolase polypeptide. In certain such embodiments, the acetoacetyl-CoA thiolase polypeptide comprises an amino acid sequence having at least 85% sequence identity to SEQ ID NO:31.

In some embodiments of the disclosure, the modified host cell comprises one or more heterologous nucleic acids comprising a nucleotide sequence encoding a pyruvate decarboxylase (PDC) polypeptide. In certain such embodiments, the PDC polypeptide comprises an amino acid sequence having at least 85% sequence identity to SEQ ID NO:35.

In some embodiments of the disclosure, the modified host cell comprises one or more heterologous nucleic acids comprising a nucleotide sequence encoding a geranyl pyrophosphate synthetase (GPPS) polypeptide. In certain such embodiments, the GPPS polypeptide comprises an amino acid sequence having at least 85% sequence identity to SEQ ID NO:41.

In some embodiments of the disclosure, the modified host cell comprises one or more heterologous nucleic acids comprising a nucleotide sequence encoding a KAR2 polypeptide. In certain such embodiments, the KAR2 polypeptide comprises an amino acid sequence having at least 85% sequence identity to SEQ ID NO:5. In some embodiments, the modified host cell comprises two or more heterologous nucleic acids comprising a nucleotide sequence encoding a KAR2 polypeptide.

In some embodiments of the disclosure, the modified host cell comprises one or more heterologous nucleic acids comprising a nucleotide sequence encoding a PDI1 polypeptide. In certain such embodiments, the PDI1 polypeptide comprises an amino acid sequence having at least 85% sequence identity to SEQ ID NO:9.

In some embodiments of the disclosure, the modified host cell comprises one or more heterologous nucleic acids comprising a nucleotide sequence encoding an IRE1 polypeptide. In certain such embodiments, the IRE1 polypeptide comprises an amino acid sequence having at least 85% sequence identity to SEQ ID NO:11 or SEQ ID NO:296.

In some embodiments of the disclosure, the modified host cell comprises one or more heterologous nucleic acids comprising a nucleotide sequence encoding an ERO1 polypeptide. In certain such embodiments, the ERO1 polypeptide comprises an amino acid sequence having at least 85% sequence identity to SEQ ID NO:7.

In some embodiments of the disclosure, the modified host cell comprises one or more heterologous nucleic acids comprising a nucleotide sequence encoding a FAD1 polypeptide. In certain such embodiments, the FAD1 polypeptide comprises an amino acid sequence having at least 85% sequence identity to SEQ ID NO:298.

In some embodiments of the disclosure, the modified host cell comprises a deletion or downregulation of one or more genes encoding a PEP4 polypeptide. In certain such embodiments, the PEP4 polypeptide comprises an amino acid sequence having at least 85% sequence identity to SEQ ID NO:15.

In some embodiments of the disclosure, the modified host cell comprises a deletion or downregulation of one or more genes encoding a ROT2 polypeptide. In certain such embodiments, the ROT2 polypeptide comprises an amino acid sequence having at least 85% sequence identity to SEQ ID NO:13.

In some embodiments of the disclosure, the modified host cell is a eukaryotic cell. In certain such embodiments, the eukaryotic cell is a yeast cell. In certain such embodiments, the yeast cell is *Saccharomyces cerevisiae*. In certain such embodiments, the *Saccharomyces cerevisiae* is a protease-deficient strain of *Saccharomyces cerevisiae*.

In some embodiments of the disclosure, at least one of the one or more nucleic acids are integrated into the chromosome of the modified host cell. In some embodiments of the disclosure, at least one of the one or more nucleic acids are maintained extrachromosomally (e.g., on a plasmid or artificial chromosome). In some embodiments of the disclosure, at least one of the one or more nucleic acids are operably-linked to an inducible promoter. In some embodiments of the disclosure, at least one of the one or more nucleic acids are operably-linked to a constitutive promoter.

In some embodiments of the disclosure, the modified host cell produces a cannabinoid or a cannabinoid derivative in an amount, as measured in mg/L or mM, greater than an amount of the cannabinoid or the cannabinoid derivative produced by a modified host cell comprising one or more nucleic acids comprising a nucleotide sequence encoding a cannabidiolic acid synthase polypeptide having an amino acid sequence of SEQ ID NO:3, wherein the modified host cell comprising one or more nucleic acids comprising the nucleotide sequence encoding the cannabidiolic acid synthase polypeptide having the amino acid sequence of SEQ ID NO:3 lacks a nucleic acid comprising a nucleotide sequence encoding an engineered variant of the disclosure, grown under similar culture conditions for the same length of time.

In some embodiments of the disclosure, the modified host cell produces a cannabinoid or a cannabinoid derivative in an amount, as measured in mg/L or mM, at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% greater than an amount of the cannabinoid or the cannabinoid derivative produced by a modified host cell comprising one or more nucleic acids comprising a nucleotide sequence encoding a cannabidiolic acid synthase polypeptide having an amino acid sequence of SEQ ID NO:3, wherein the modified host cell comprising one or more nucleic acids comprising the nucleotide sequence encoding the cannabidiolic acid synthase polypeptide having the amino acid sequence of SEQ ID NO:3 lacks a nucleic acid comprising a nucleotide sequence encoding an engineered variant of the disclosure, grown under similar culture conditions for the same length of time.

In some embodiments of the disclosure, the modified host cell has a faster growth rate and/or higher biomass yield compared to a growth rate and/or higher biomass yield of a modified host cell comprising one or more nucleic acids comprising a nucleotide sequence encoding a cannabidiolic acid synthase polypeptide having an amino acid sequence of SEQ ID NO:3, wherein the modified host cell comprising one or more nucleic acids comprising the nucleotide sequence encoding the cannabidiolic acid synthase polypeptide having the amino acid sequence of SEQ ID NO:3 lacks a nucleic acid comprising a nucleotide sequence encoding an engineered variant of the disclosure, grown under similar culture conditions for the same length of time.

In some embodiments of the disclosure, the modified host cell has a growth rate and/or higher biomass yield at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% faster than a growth rate and/or higher biomass yield of a modified host cell comprising one or more nucleic acids comprising a nucleotide sequence encoding a cannabidiolic acid synthase polypeptide having an amino acid sequence of SEQ ID NO:3, wherein the modified host cell comprising one or more nucleic acids comprising the nucleotide sequence encoding the cannabidiolic acid synthase polypeptide having the amino acid sequence of SEQ ID NO:3 lacks a nucleic acid comprising a nucleotide sequence encoding an engineered variant of the disclosure, grown under similar culture conditions for the same length of time.

In some embodiments of the disclosure, the modified host cell produces cannabidiolic acid (CBDA) from cannabigerolic acid (CBGA) in an increased ratio of CBDA over tetrahydrocannabinolic acid (THCA) compared to that produced by a modified host cell comprising one or more nucleic acids comprising a nucleotide sequence encoding a cannabidiolic acid synthase polypeptide having an amino acid sequence of SEQ ID NO:3, wherein the modified host cell comprising one or more nucleic acids comprising the nucleotide sequence encoding the cannabidiolic acid synthase polypeptide having the amino acid sequence of SEQ ID NO:3 lacks a nucleic acid comprising a nucleotide sequence encoding an engineered variant of the disclosure, grown under similar culture conditions for the same length of time.

In some embodiments of the disclosure, the modified host cell produces CBDA from CBGA in a ratio of CBDA over THCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

In some embodiments of the disclosure, the modified host cell produces cannabidiolic acid (CBDA) from cannabigerolic acid (CBGA) in an increased ratio of CBDA over cannabichromenic acid (CBCA) compared to that produced by a modified host cell comprising one or more nucleic acids comprising a nucleotide sequence encoding a cannabidiolic acid synthase polypeptide having an amino acid sequence of SEQ ID NO:3, wherein the modified host cell comprising one or more nucleic acids comprising the nucleotide sequence encoding the cannabidiolic acid synthase polypeptide having the amino acid sequence of SEQ ID NO:3 lacks a nucleic acid comprising a nucleotide sequence encoding an engineered variant of the disclosure, grown under similar culture conditions for the same length of time.

In some embodiments of the disclosure, the modified host cell produces CBDA from CBGA in a ratio of CBDA over CBCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

Another aspect of the disclosure relates to a method of producing a cannabinoid or a cannabinoid derivative, the method comprising: a) culturing a modified host cell of the disclosure in a culture medium. In certain such embodiments, the method comprises: b) recovering the produced cannabinoid or cannabinoid derivative. In some embodiments, the culture medium comprises a carboxylic acid. In certain such embodiments, the carboxylic acid is an unsubstituted or substituted $C_3$-$C_{18}$ carboxylic acid. In certain such embodiments, the unsubstituted or substituted $C_3$-$C_{18}$ carboxylic acid is an unsubstituted or substituted hexanoic acid. In some embodiments, the culture medium comprises olivetolic acid or an olivetolic acid derivative. In some embodiments, the cannabinoid is cannabidiolic acid, cannabidiol, cannabidivarinic acid, or cannabidivarin. In some embodiments, the culture medium comprises a fermentable sugar. In some embodiments, the culture medium comprises a pretreated cellulosic feedstock. In some embodiments, the culture medium comprises a non-fermentable carbon source. In certain such embodiments, the non-fermentable carbon source comprises ethanol. In some embodiments, the cannabinoid or the cannabinoid derivative is produced in an amount of more than 100 mg/L culture medium.

In some embodiments of the methods of the disclosure, the cannabinoid or the cannabinoid derivative is produced in an amount, as measured in mg/L or mM, greater than an amount of the cannabinoid or the cannabinoid derivative produced in a method comprising culturing a modified host cell comprising one or more nucleic acids comprising a nucleotide sequence encoding a cannabidiolic acid synthase polypeptide having an amino acid sequence of SEQ ID NO:3 instead of the modified host cell of the disclosure, wherein the modified host cell comprising one or more nucleic acids comprising the nucleotide sequence encoding the cannabidiolic acid synthase polypeptide having the amino acid sequence of SEQ ID NO:3 lacks a nucleic acid comprising a nucleotide sequence encoding an engineered variant of the disclosure, and wherein the modified host cell of the disclosure and the modified host cell comprising one or more nucleic acids comprising the nucleotide sequence encoding the cannabidiolic acid synthase polypeptide having the amino acid sequence of SEQ ID NO:3, but lacking a nucleic acid comprising a nucleotide sequence encoding an engineered variant of the disclosure, are cultured under similar culture conditions for the same length of time.

In some embodiments of the methods of the disclosure, the cannabinoid or the cannabinoid derivative is produced in an amount, as measured in mg/L or mM, at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% greater than an amount of the cannabinoid or the cannabinoid derivative produced in a method comprising culturing a modified host cell comprising one or more nucleic acids comprising a nucleotide sequence encoding a cannabidiolic acid synthase polypeptide having an amino acid sequence of SEQ ID NO:3 instead of the modified host cell of the disclosure, wherein the modified host cell comprising one or more nucleic acids comprising the nucleotide sequence encoding the cannabidiolic acid synthase polypeptide having the amino acid sequence of SEQ ID NO:3 lacks a nucleic acid comprising a nucleotide sequence encoding an engineered variant of the disclosure, and wherein the modified host cell of the disclosure and the modified host cell comprising one or more nucleic acids comprising the nucleotide sequence encoding the cannabidiolic acid synthase polypeptide having the amino acid sequence of SEQ ID NO:3, but lacking a nucleic acid comprising a nucleotide sequence encoding an engineered variant of the disclosure, are cultured under similar culture conditions for the same length of time.

In some embodiments of the methods of the disclosure, the cannabinoid is cannabidiolic acid (CBDA), and wherein the method produces CBDA in an increased ratio of CBDA over tetrahydrocannabinolic acid (THCA) compared to that produced in a method comprising culturing a modified host cell comprising one or more nucleic acids comprising a nucleotide sequence encoding a cannabidiolic acid synthase polypeptide having an amino acid sequence of SEQ ID NO:3 instead of the modified host cell of the disclosure, wherein the modified host cell comprising one or more nucleic acids comprising the nucleotide sequence encoding the cannabidiolic acid synthase polypeptide having the amino acid sequence of SEQ ID NO:3 lacks a nucleic acid comprising a nucleotide sequence encoding an engineered variant of the disclosure, grown under similar culture conditions for the same length of time.

In some embodiments of the methods of the disclosure, the cannabinoid is cannabidiolic acid (CBDA), and wherein the method produces CBDA in an increased ratio of CBDA over cannabichromenic acid (CBCA) compared to that produced in a method comprising culturing a modified host cell comprising one or more nucleic acids comprising a nucleotide sequence encoding a cannabidiolic acid synthase polypeptide having an amino acid sequence of SEQ ID NO:3 instead of the modified host cell of the disclosure, wherein the modified host cell comprising one or more nucleic acids comprising the nucleotide sequence encoding the cannabidiolic acid synthase polypeptide having the amino acid sequence of SEQ ID NO:3 lacks a nucleic acid comprising a nucleotide sequence encoding an engineered variant of the disclosure, grown under similar culture conditions for the same length of time.

An aspect of the disclosure relates to a method of producing a cannabinoid or a cannabinoid derivative, the method comprising use of an engineered variant of the disclosure. In certain such embodiments, the method comprises recovering the produced cannabinoid or cannabinoid derivative. In some embodiments of the methods of the disclosure, the cannabinoid is cannabidiolic acid, cannabidiol, cannabidivarinic acid, or cannabidivarin.

In some embodiments of the methods of the disclosure, the cannabinoid or the cannabinoid derivative is produced in an amount, as measured in mg/L or mM, greater than an amount of the cannabinoid or the cannabinoid derivative produced in a method comprising use of a cannabidiolic acid synthase polypeptide having an amino acid sequence of SEQ ID NO:3 instead of the engineered variant of the disclosure, wherein the engineered variant of the disclosure and the cannabidiolic acid synthase polypeptide having the amino acid sequence of SEQ ID NO:3 are used under similar conditions for the same length of time.

In some embodiments of the methods of the disclosure, the cannabinoid or the cannabinoid derivative is produced in an amount, as measured in mg/L or mM, at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% greater than an amount of the cannabinoid or the cannabinoid derivative produced in a method comprising use of a cannabidiolic acid synthase polypeptide having an amino acid sequence of SEQ ID NO:3 instead of the engineered variant of the disclosure, wherein the engineered variant of the disclosure and the cannabidiolic acid synthase polypeptide having the amino acid sequence of SEQ ID NO:3 are used under similar conditions for the same length of time.

In some embodiments of the methods of the disclosure, the cannabinoid is cannabidiolic acid (CBDA), and wherein the method produces CBDA in an increased ratio of CBDA over tetrahydrocannabinolic acid (THCA) compared to that produced in a method comprising use of a cannabidiolic acid synthase polypeptide having an amino acid sequence of SEQ ID NO:3 instead of the engineered variant of the disclosure, wherein the engineered variant of the disclosure and the cannabidiolic acid synthase polypeptide having the amino acid sequence of SEQ ID NO:3 are used under similar conditions for the same length of time.

In some embodiments of the methods of the disclosure, the method produces CBDA from CBGA in a ratio of CBDA over THCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

In some embodiments of the methods of the disclosure, the cannabinoid is cannabidiolic acid (CBDA), and wherein the method produces CBDA in an increased ratio of CBDA over cannabichromenic acid (CBCA) compared to that produced in a method comprising use of a cannabidiolic acid synthase polypeptide having an amino acid sequence of SEQ ID NO:3 instead of the engineered variant of the disclosure, wherein the engineered variant of the disclosure and the cannabidiolic acid synthase polypeptide having the amino acid sequence of SEQ ID NO:3 are used under similar conditions for the same length of time.

In some embodiments of the methods of the disclosure, the method produces CBDA from CBGA in a ratio of CBDA over CBCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

Another aspect of the disclosure relates to a method of screening an engineered variant of a cannabidiolic acid synthase (CBDAS) polypeptide comprising an amino acid sequence of SEQ ID NO:3 with one or more amino acid substitutions, the method comprising: a) dividing a population of host cells into a control population and a test population; b) co-expressing in the control population a CBDAS polypeptide having an amino acid sequence of SEQ ID NO:3 and a comparison cannabinoid synthase polypeptide, wherein the CBDAS polypeptide having an amino acid sequence of SEQ ID NO:3 can convert cannabigerolic acid (CBGA) to a first cannabinoid, cannabidiolic acid (CBDA), and the comparison cannabinoid synthase polypeptide can convert the same CBGA to a different second cannabinoid; c) co-expressing in the test population the engineered variant and the comparison cannabinoid synthase polypeptide, wherein the engineered variant may convert CBGA to the same first cannabinoid, cannabidiolic acid (CBDA), as the CBDAS polypeptide having an amino acid sequence of SEQ ID NO:3, and wherein the comparison cannabinoid synthase polypeptide can convert the same CBGA to the second cannabinoid and is expressed at similar levels in the test population and in the control population; d) measuring a ratio of the first cannabinoid, cannabidiolic acid (CBDA), over the second cannabinoid produced by both the test population and the control population; and e) measuring an amount, in mg/L or mM, of the first cannabinoid produced by both the test population and the control population. In certain such embodiments, the test population is identified as comprising an engineered variant having improved in vivo performance compared to the cannabidiolic acid synthase polypeptide having an amino acid sequence of SEQ ID NO:3, wherein improved in vivo performance is demonstrated by an increase in the ratio of the first cannabinoid over the second cannabinoid produced by the test population compared to that produced by the control population under similar culture conditions for the same length of time. In some embodiments of the method of screening the engineered variant of a CBDAS polypeptide, the test population is identified as comprising an engineered variant having improved in vivo performance compared to the cannabidiolic acid synthase polypeptide having an amino acid sequence of SEQ ID NO:3 by producing the first cannabinoid in a greater amount, as measured in mg/L or mM, by the test population compared to the amount produced by the control population under similar culture conditions for the same length of time.

In some embodiments of the method of screening the engineered variant of a CBDAS polypeptide, the cannabinoid synthase polypeptide is a tetrahydrocannabinolic acid synthase polypeptide. In certain such embodiments, the tetrahydrocannabinolic acid synthase polypeptide comprises an amino acid sequence having at least 85% sequence identity to SEQ ID NO:44. In some embodiments of the method of screening the engineered variant of a CBDAS polypeptide, the second cannabinoid is tetrahydrocannabinolic acid (THCA).

In some embodiments of the method of screening the engineered variant of a CBDAS polypeptide, the engineered variant is an engineered variant of the disclosure.

DETAILED DESCRIPTION

Figure 1A:
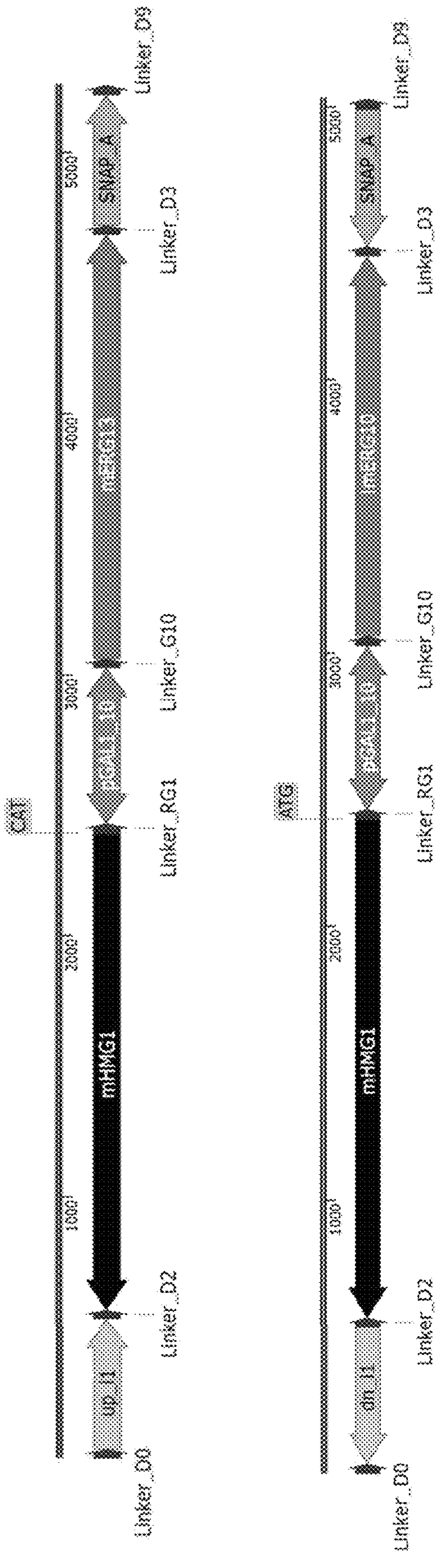
FIGS. 1A, 1B, and 1C depict expression constructs used in the production of the S29 strain. The expression constructs depicted in FIGS. 1A, 1B, and 1C were also used in the production of the following strains: S61, S122, S171, S181, S206, S220, S241, S270, S478, S487, S510, S562, S579, S606-S791, S1100-S1120, S935, S938, S940-S946, and S1205-S1208. Throughout the figures, in addition to the specified coding sequences from Table 1, construct maps depict regulatory, non-coding and genomic cassette sequences described in Table 6. Construct maps also depict genes denoted with a preceding "m" (e.g., mERG13), which specify open reading frames from Table 1 with 200-250 base pairs (bp) of downstream regulatory (terminator) sequence. Arrows in construct maps indicate the directionality of certain DNA parts. The "!" preceding a part name is an output of the DNA design software used, is redundant with the arrow directionality, and can be ignored.

Synthetic biology allows for the engineering of industrial host organisms—e.g., microbes—to convert simple sugar feedstocks into medicines. This approach includes identifying genes that produce the target molecules and optimizing their activities in the industrial host. Microbial production can be significantly cost-advantaged over agriculture and chemical synthesis, less variable, and allow tailoring of the target molecule. However, reconstituting or creating a pathway to produce a target molecule in an industrial host organism can require significant engineering of both the pathway genes and the host. The present disclosure provides engineered variants of a cannabidiolic acid synthase (CBDAS) polypeptide comprising an amino acid sequence of SEQ ID NO:3 with one or more amino acid substitutions, nucleic acids comprising nucleotide sequences encoding said engineered variants, methods of making modified host cells comprising said nucleic acids, modified host cells for producing cannabinoids or cannabinoid derivatives, methods of producing cannabinoids or cannabinoid derivatives, and methods of screening engineered variants of the CBDAS polypeptide. The engineered variants of the disclosure may be useful for producing cannabinoids or cannabinoid derivatives (e.g., non-naturally occurring cannabinoids). The modified host cells of the disclosure may be useful for producing cannabinoids or cannabinoid derivatives (e.g., non-naturally occurring cannabinoids) and/or for expressing engineered variants of the disclosure. The disclosure also provides for modified host cells for expressing the engineered variants of the disclosure. Additionally, the disclosure provides for preparation of engineered variants of the disclosure.

Cannabinoid synthase polypeptides, such as tetrahydrocannabinolic acid synthase, cannabichromenic acid synthase, or cannabidiolic acid synthase polypeptides, play an important role in the biosynthesis of cannabinoids. However, reconstituting their activity in a modified host cell has proven challenging, hampering progress in the production of cannabinoids or cannabinoid derivatives. Cannabinoid synthases must successfully traverse the secretory pathway to fold and function properly. These secreted plant enzymes have not evolved to be expressed in a yeast cell, and as a result have poor activity, with limited conversion of their substrate cannabigerolic acid (CBGA) into cannabidiolic acid (CBDA), cannabichromenic acid (CBCA), or tetrahydrocannabinolic acid (THCA). A simple method to increase activity of an enzyme is to increase its copy number (expression). However, expression of cannabinoid synthase genes, such as CBDAS and tetrahydrocannabinolic acid synthase (THCAS) genes, in yeast is toxic (likely owing to misfolding of the protein), frustrating straightforward attempts to boost activity by integrating multiple copies of the genes. Product profile presents another problem. While the primary product of the natural CBDAS enzyme is CBDA, the enzyme also makes significant amounts of THCA and CBCA, undesired byproducts, which would require expensive additional downstream purification steps to separate in an industrial process.

For these reasons, the natural cannabinoid synthase enzymes, such as CBDAS or THCAS enzymes, are not optimal for industrial purposes, and improved enzymes are required. Parameters of interest include catalytic activity, product profile, enzyme stability, and pH and temperature optima. Enzyme improvement is typically accomplished by coupling the generation of diversity (a library of engineered variants) to a screen or selection for the properties of interest. DNA libraries encoding engineered variants can be generated in a variety of ways. For example, libraries can be generated using error prone PCR using the wild type gene sequence as a template. The resulting library can be quite large, consisting of genes with variable numbers of mutations at random positions. Error prone PCR is inexpensive and convenient but has several drawbacks. First, instead of a precise number of mutations per construct, a distribution is obtained. This presents an unfortunate trade-off. A distribution centered around a low number of mutations will include a significant amount of zero-mutation wild-type constructs that waste screening capacity. A distribution centered around a higher number of mutations is likely to generate constructs that have accumulated loss of function mutations that would prevent identification of the desired gain of function mutations. Second, error prone PCR introduces mutational bias (an intrinsic property of the low fidelity polymerases used) which means that the library underrepresents certain types of mutation. A powerful alternative to error prone PCR is saturation mutagenesis, which involves synthesis of a library containing every possible amino acid at every position in the protein. Recent advances in DNA synthesis technologies have improved the quality of these libraries significantly.

Once a library encoding engineered variants is generated, it is necessary to select or screen for engineered variants with the properties of interest. This can be accomplished by using a protein production host to express and purify the engineered variants, followed by testing in vitro. Such an approach allows careful measurement of the engineered variants' kinetic parameters and assessment of performance under carefully controlled conditions. However, for application in an engineered microbial strain, in vitro data can be highly misleading as no in vitro system can represent the cellular milieu accurately. In this case, the best option is to test the engineered variants in the exact context they must eventually perform—inside an engineered production strain. In the case of the cannabinoid synthases, such a production strain would be engineered to produce the substrate CBGA in excess. One challenge with this in vivo system is that variability is higher. When testing a large library, this variability can make it difficult to distinguish clones with more subtle improvements over the wild type enzyme activity. To address this issue, competition approaches can be valuable. In a competition system, the library engineered variant is expressed alongside a related enzyme (e.g., a library CBDAS construct alongside a THCAS construct). By calculating the ratio of the library enzyme product titer and the invariant competition enzyme titer, it is possible to reduce the variability in data significantly. This is because biological variables tend to affect both of the enzymes in the same way, allowing normalization of the effect. Unlike a kinetic parameter, the competition ratio reports on both changes in both enzyme catalytic parameters such as $K_m$ and $K_{cat}$ as well as changes in the steady state levels of functional engineered variant (expression and stability).

Through use of the above methods, the present disclosure provides engineered variants of a cannabidiolic acid synthase (CBDAS) polypeptide. Herein, over 6500 engineered variants were screened for improvement of titer. CBDA titers were improved (outside standard deviation of wild type) in 68 distinct variants covering 52 positions (nearly 10% of all residues). In a second effort, more intensive screening of 75 active site residues (defined by ~11 angstrom proximity to the active site tyrosine at position 483) was conducted to identify mutations that reduce THCA (and in some cases CBCA production) by the CBDA synthase polypeptide. These active site residues included: 69, 70, 72, 113, 114, 115, 116, 117, 118, 119, 155, 173, 174, 175, 176, 177, 179, 183, 184, 185, 186, 187, 188, 189, 190, 191, 192, 232, 234, 236, 289, 291, 353, 380, 381, 382, 383, 384, 385, 386, 412, 413, 414, 415, 416, 418, 432, 434, 441, 442, 443, 444, 445, 446, 461, 465, 477, 478, 479, 480, 481, 482, 483, 484, 485, 486, 487, 488, 489, 505, 508, 509, 510, 532, and 534 of the CBDAS polypeptide of SEQ ID NO:3 from *Cannabis sativa*. Engineered variants of the disclosure may be useful for producing cannabinoids or cannabinoid derivatives (e.g., non-naturally occurring cannabinoids). The engineered variants of the disclosure may produce cannabidiolic acid (CBDA) from cannabigerolic acid (CBGA) in a greater amount, as measured in mg/L or mM, than an amount of CBDA produced from CBGA by a cannabidiolic acid synthase polypeptide having an amino acid sequence of SEQ ID NO:3 under similar conditions for the same length of time. Additionally, the engineered variants of the disclosure may produce CBDA from CBGA in an increased ratio of CBDA over THCA compared to that produced by a cannabidiolic acid synthase polypeptide having an amino acid sequence of SEQ ID NO:3 under similar conditions for the same length of time. In some embodiments, the engineered variants of the disclosure may produce CBDA from CBGA in an increased ratio of CBDA over CBCA compared to that produced by a cannabidiolic acid synthase polypeptide having an amino acid sequence of SEQ ID NO:3 under similar conditions for the same length of time. Similar conditions may include the same temperature, pH, buffer, and/or fermentation conditions and in the same culture medium and/or reaction solvent.

The methods of the disclosure may include using engineered microorganisms (e.g., modified host cells) or engineered variants of a CBDAS polypeptide of the disclosure to produce naturally-occurring and non-naturally occurring cannabinoids. Naturally-occurring cannabinoids and non-naturally occurring cannabinoids (e.g., cannabinoid derivatives) are challenging to produce using chemical synthesis due to their complex structures. The methods of the disclosure enable the construction of metabolic pathways inside living cells to produce bespoke cannabinoids or cannabinoid derivatives from simple precursors such as sugars and carboxylic acids. One or more nucleic acids (e.g., heterologous nucleic acids) disclosed herein comprising nucleotide sequences encoding one or more polypeptides or engineered variants disclosed herein can be introduced into host microorganisms allowing for the stepwise conversion of inexpensive feedstocks, e.g., sugar, into final products: cannabinoids or cannabinoid derivatives. These products can be specified by the choice and construction of expression constructs or vectors comprising one or more nucleic acids (e.g., heterologous nucleic acids) disclosed herein, allowing for the efficient bioproduction of chosen cannabinoids, such as CBD and CBDA and less common cannabinoid species found at low levels in *Cannabis*; or cannabinoid derivatives. Bioproduction also enables synthesis of cannabinoids or cannabinoid derivatives with defined stereochemistries, which is challenging to do using chemical synthesis. To produce cannabinoids or cannabinoid derivatives and create biosynthetic pathways within modified host cells, modified host cells comprising one or more nucleic acids comprising a nucleotide sequence encoding an engineered variant of a CBDAS polypeptide of the disclosure may express or overexpress combinations of heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In some embodiments, the nucleotide sequences encoding the polypeptides involved in cannabinoid or cannabinoid precursor (e.g., geranylpyrophosphate (GPP), prenyl phosphates, olivetolic acid, or hexanoyl-CoA) biosynthesis are codon-optimized.

The disclosure also provides for modification of the secretory pathway of a host cell modified with one or more nucleic acids (e.g., heterologous nucleic acids) comprising a nucleotide sequence encoding an engineered variant of a CBDAS polypeptide of the disclosure. In some embodiments, the nucleotide sequence encoding the engineered variant of a CBDAS polypeptide is codon-optimized. Modification of the secretory pathway in the host cell may improve expression and solubilization of the engineered variants of the disclosure, as these variants are processed through the secretory pathway. Reconstituting the activity of polypeptides processed through the secretory pathway, such as the engineered variants of the disclosure, in a modified host cell, such as a modified yeast cell, can be challenging and unreliable. Often the expressed engineered variants may be misfolded or mislocalized, resulting in low expression, expressed engineered variants lacking activity, engineered variant aggregation, reduced host cell viability, and/or cell death. Additionally, a backlog of misfolded or mislocalized expressed engineered variants can induce metabolic stress within the modified host cell, harming the modified host cell. The expressed engineered variants may lack necessary post-translational modifications for folding and activity, such as disulfide bonds, glycosylation and trimming, and cofactors, affording inactive polypeptides or polypeptides with reduced enzymatic activity.

The modified host cell of the disclosure may be a modified yeast cell. Yeast cells may be cultured using known conditions, grow rapidly, and are generally regarded as safe. Yeast cells contain the secretory pathway common to all eukaryotes. As disclosed herein, manipulation of that secretory pathway in yeast host cells modified with one or more nucleic acids (e.g., heterologous nucleic acids) comprising a nucleotide sequence encoding an engineered variant of a CBDAS polypeptide of the disclosure may improve expression, folding, and enzymatic activity of the engineered variant as well as viability of the modified yeast host cell, such as modified *Saccharomyces cerevisiae*. Further, use of codon-optimized nucleotide sequences encoding engineered variants of the disclosure may improve expression and activity of the engineered variant and viability of modified yeast host cells, such as modified *Saccharomyces cerevisiae*.

Besides allowing for the production of desired cannabinoids or cannabinoid derivatives, the present disclosure provides a more reliable and economical process than agriculture-based production. Microbial fermentations can be completed in days versus the months necessary for an agricultural crop, are not affected by climate variation or soil contamination (e.g., by heavy metals), and can produce pure products at high titer.

The present disclosure also provides a platform for the economical production of high-value cannabinoids, including CBD, as well as derivatives thereof. It also provides for the production of different cannabinoids or cannabinoid derivatives for which no viable method of production exists. Using the engineered variants, methods, and modified host cells disclosed herein, cannabinoids and cannabinoid derivatives may be produced in an amount of over 100 mg per liter of culture medium, over 1 g per liter of culture medium, over 10 g per liter of culture medium, or over 100 g per liter of culture medium.

Additionally, the disclosure provides engineered variants of a CBDAS polypeptide, methods, modified host cells, and nucleic acids to produce cannabinoids or cannabinoid derivatives in vivo or in vitro from simple precursors. Nucleic acids (e.g., heterologous nucleic acids) disclosed herein can be introduced into microorganisms (e.g., modified host cells), resulting in expression or overexpression of one or more polypeptides, such as the engineered variants of the disclosure, which can then be utilized in vitro or in vivo for the production of cannabinoids or cannabinoid derivatives. In some embodiments, the in vitro methods are cell-free.

Cannabinoid Biosynthesis

In addition to one or more nucleic acids (e.g., heterologous nucleic acids) encoding an engineered variant of a CBDAS polypeptide, one or more nucleic acids (e.g., heterologous nucleic acids) encoding one or more polypeptides having at least one activity of a polypeptide present in the cannabinoid or cannabinoid precursor biosynthetic pathway may be useful in the methods and modified host cells for the synthesis of cannabinoids or cannabinoid derivatives. Cannabinoid precursors may include, for example, geranylpyrophosphate (GPP), prenyl phosphates, olivetolic acid, or hexanoyl-CoA.

In *Cannabis*, cannabinoids are produced from the common metabolite precursors geranylpyrophosphate (GPP) and hexanoyl-CoA by the action of three polypeptides. Hexanoyl-CoA and malonyl-CoA are combined to afford a 12-carbon tetraketide intermediate by a tetraketide synthase (TKS) polypeptide. This tetraketide intermediate is then cyclized by an olivetolic acid cyclase (OAC) polypeptide to produce olivetolic acid. Olivetolic acid is then prenylated with the common isoprenoid precursor GPP by a geranyl pyrophosphate:olivetolic acid geranyltransferase (GOT) polypeptide (e.g., a CsPT4 polypeptide) to produce CBGA, the cannabinoid also known as the "mother cannabinoid."

The engineered variants of a CBDAS polypeptide of the disclosure then convert CBGA into other cannabinoids, e.g., CBDA, etc. In the presence of heat or light, the acidic cannabinoids can undergo decarboxylation, e.g., CBDA producing CBD.

GPP and hexanoyl-CoA can be generated through several pathways. One or more nucleic acids (e.g., heterologous nucleic acids) encoding one or more polypeptides having at least one activity of a polypeptide present in these pathways can be useful in the methods and modified host cells for the synthesis of cannabinoids or cannabinoid derivatives.

Polypeptides that generate GPP or are part of a biosynthetic pathway that generates GPP may be one or more polypeptides having at least one activity of a polypeptide present in the mevalonate (MEV) pathway (e.g., one or more MEV pathway polypeptides). The term "mevalonate pathway" or "MEV pathway," as used herein, may refer to the biosynthetic pathway that converts acetyl-CoA to isopentenyl pyrophosphate (IPP) and dimethylallyl pyrophosphate (DMAPP). The mevalonate pathway comprises polypeptides that catalyze the following steps: (a) condensing two molecules of acetyl-CoA to generate acetoacetyl-CoA (e.g., by action of an acetoacetyl-CoA thiolase polypeptide); (b) condensing acetoacetyl-CoA with acetyl-CoA to form hydroxymethylglutaryl-CoA (HMG-CoA) (e.g., by action of a HMG-CoA synthase (HMGS) polypeptide); (c) converting HMG-CoA to mevalonate (e.g., by action of a HMG-CoA reductase (HMGR) polypeptide); (d) phosphorylating mevalonate to mevalonate 5-phosphate (e.g., by action of a mevalonate kinase (MK) polypeptide); (e) converting mevalonate 5-phosphate to mevalonate 5-pyrophosphate (e.g., by action of a phosphomevalonate kinase (PMK) polypeptide); (f) converting mevalonate 5-pyrophosphate to isopentenyl pyrophosphate (e.g., by action of a mevalonate pyrophosphate decarboxylase (MVD1) polypeptide); and (g) converting isopentenyl pyrophosphate (IPP) to dimethylallyl pyrophosphate (DMAPP) (e.g., by action of an isopentenyl pyrophosphate isomerase (IDI1) polypeptide). A geranyl pyrophosphate synthetase (GPPS) polypeptide then acts on IPP and/or DMAPP to generate GPP.

Polypeptides that generate hexanoyl-CoA may include polypeptides that generate acyl-CoA compounds or acyl-CoA compound derivatives (e.g., an acyl-activating enzyme polypeptide, a fatty acyl-CoA synthetase polypeptide, or a fatty acyl-CoA ligase polypeptide). Hexanoyl CoA derivatives, acyl-CoA compounds, or acyl-CoA compound derivatives may also be formed via such polypeptides.

Biosynthetic pathways to cannabinoids

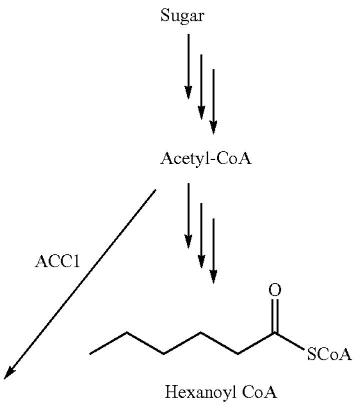

Hexanoyl CoA

-continued
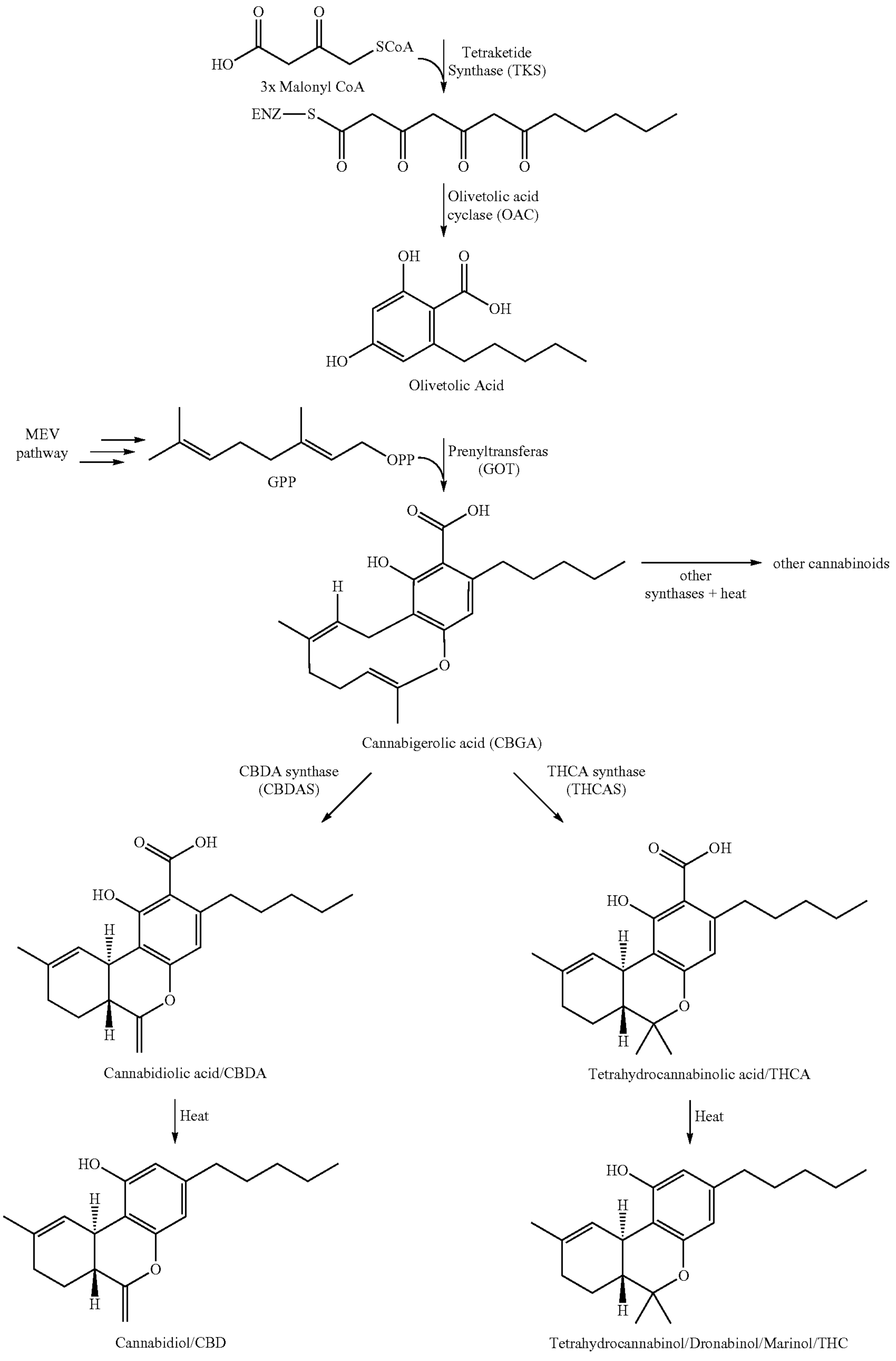

GPP and hexanoyl-CoA may also be generated through pathways comprising polypeptides that condense two molecules of acetyl-CoA to generate acetoacetyl-CoA and pyruvate decarboxylase polypeptides that generate acetyl-CoA from pyruvate via acetaldehyde. Hexanoyl CoA derivatives, acyl-CoA compounds, or acyl-CoA compound derivatives may also be formed via such pathways.

General Information

In certain aspects, the practice of the present disclosure will employ, unless otherwise indicated, conventional techniques of molecular biology (including recombinant techniques), microbiology, cell biology, biochemistry, and immunology, which are within the skill of the art. Such techniques are explained fully in the literature: "*Molecular Cloning: A Laboratory Manual*," second edition (Sambrook et al., 1989); "*Oligonucleotide Synthesis*" (M. J. Gait, ed., 1984); "*Animal Cell Culture*" (R. I. Freshney, ed., 1987); "*Methods in Enzymology*" (Academic Press, Inc.); "*Current Protocols in Molecular Biology*" (F. M. Ausubel et al., eds., 1987, and periodic updates); "*PCR: The Polymerase Chain Reaction*," (Mullis et al., eds., 1994). Singleton et al., *Dictionary of Microbiology and Molecular Biology* 2nd ed., J. Wiley & Sons (New York, N.Y. 1994), and March, *Advanced Organic Chemistry Reactions, Mechanisms and Structure* 4th ed., John Wiley & Sons (New York, N.Y. 1992), provide one skilled in the art with a general guide to many of the terms used in the present application.

"Cannabinoid" or "cannabinoid compound" as used herein may refer to a member of a class of unique meroterpenoids found until now only in *Cannabis sativa*. Cannabinoids may include, but are not limited to, cannabichromene (CBC) type (e.g., cannabichromenic acid), cannabigerol (CBG) type (e.g., cannabigerolic acid), cannabidiol (CBD) type (e.g., cannabidiolic acid), $\Delta^9$-trans-tetrahydrocannabinol ($\Delta^9$-THC) type (e.g., $\Delta^9$-tetrahydrocannabinolic acid), $\Delta^8$-trans-tetrahydrocannabinol ($\Delta^8$-THC) type, cannabicyclol (CBL) type, cannabielsoin (CBE) type, cannabinol (CBN) type, cannabinodiol (CBND) type, cannabitriol (CBT) type, cannabigerolic acid (CBGA), cannabigerolic acid monomethylether (CBGAM), cannabigerol (CBG), cannabigerol monomethylether (CBGM), cannabigerovarinic acid (CBGVA), cannabigerovarin (CBGV), cannabichromenic acid (CBCA), cannabichromene (CBC), cannabichromevarinic acid (CBCVA), cannabichromevarin (CBCV), cannabidiolic acid (CBDA), cannabidiol (CBD), cannabidiol monomethylether (CBDM), cannabidiol-$C_4$ (CBD-$C_4$), cannabidivarinic acid (CBDVA), cannabidivarin (CBDV), cannabidiorcol (CBD-$C_1$), $\Delta^9$-tetrahydrocannabinolic acid A (THCA-A), $\Delta^9$-tetrahydrocannabinolic acid B (THCA-B), $\Delta^9$-tetrahydrocannabinol (THC), $\Delta^9$-tetrahydrocannabinolic acid-C4 (THCA-C4), $\Delta^9$-tetrahydrocannabinol-C4 (THC-C4), $\Delta^9$-tetrahydrocannabivarinic acid (THCVA), $\Delta^9$-tetrahydrocannabivarin (THCV), $\Delta^9$-tetrahydrocannabiorcolic acid (THCA-$C_1$), $\Delta^9$-tetrahydrocannabiorcol (THC-$C_1$), $\Delta^7$-cis-iso-tetrahydrocannabivarin, $\Delta^8$-tetrahydrocannabinolic acid ($\Delta^8$-THCA), $\Delta^8$-tetrahydrocannabinol ($\Delta^8$-THC), cannabicyclolic acid (CBLA), cannabicyclol (CBL), cannabicyclovarin (CBLV), cannabielsoic acid A (CBEA-A), cannabielsoic acid B (CBEA-B), cannabielsoin (CBE), cannabielsoinic acid, cannabicitranic acid, cannabinolic acid (CBNA), cannabinol (CBN), cannabinol methylether (CBNM), cannabinol-$C_4$, (CBN-$C_4$), cannabivarin (CBV), cannabinol-$C_2$ (CNB-$C_2$), cannabiorcol (CBN-$C_1$), cannabinodiol (CBND), cannabinodivarin (CBVD), cannabitriol (CBT), 10-ethyoxy-9-hydroxy-delta-6a-tetrahydrocannabinol, 8,9-dihydroxyl-delta-6a-tetrahydrocannabinol, cannabitriolvarin (CBTVE), dehydrocannabifuran (DCBF), cannabifuran (CBF), cannabichromanon (CBCN), cannabicitran (CBT), 10-oxo-delta-6a-tetrahydrocannabinol (OTHC), delta-9-cis-tetrahydrocannabinol (cis-THC), 3,4,5,6-tetrahydro-7-hydroxy-alpha-alpha-2-trimethyl-9-n-propyl-2,6-methano-2H-1-benzoxocin-5-methanol (OH-iso-HHCV), cannabiripsol (CBR), and trihydroxy-delta-9-tetrahydrocannabinol (triOH-THC).

An acyl-CoA compound as detailed herein may include compounds with the following structure:

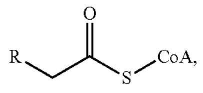

wherein R may be an unsubstituted fatty acid side chain or a fatty acid side chain substituted with or comprising one or more functional and/or reactive groups as disclosed herein (i.e., an acyl-CoA compound derivative).

As used herein, a hexanoyl CoA derivative, an acyl-CoA compound derivative, a cannabinoid derivative, or an olivetolic acid derivative may refer to hexanoyl CoA, an acyl-CoA compound, a cannabinoid, or olivetolic acid substituted with or comprising one or more functional and/or reactive groups. Functional groups may include, but are not limited to, azido, halo (e.g., chloride, bromide, iodide, fluorine), methyl, alkyl (including branched and straight chain alkyl groups), alkynyl, alkenyl, methoxy, alkoxy, acetyl, amino, carboxyl, carbonyl, oxo, ester, hydroxyl, thio (e.g., thiol), cyano, aryl, heteroaryl, cycloalkyl, cycloalkenyl, cycloalkylalkenyl, cycloalkylalkynyl, cycloalkenylalkyl, cycloalkenylalkenyl, cycloalkenylalkynyl, heterocyclylalkenyl, heterocyclylalkynyl, heteroarylalkenyl, heteroarylalkynyl, arylalkenyl, arylalkynyl, heterocyclyl, spirocyclyl, heterospirocyclyl, thioalkyl (or alkylthio), arylthio, heteroarylthio, sulfone, sulfonyl, sulfoxide, amido, alkylamino, dialkylamino, arylamino, alkylarylamino, diarylamino, N-oxide, imide, enamine, imine, oxime, hydrazone, nitrile, aralkyl, cycloalkylalkyl, haloalkyl, heterocyclylalkyl, heteroarylalkyl, nitro, thioxo, and the like. Suitable reactive groups may include, but are not necessarily limited to, azide, carboxyl, carbonyl, amine (e.g., alkyl amine (e.g., lower alkyl amine), aryl amine), halide, ester (e.g., alkyl ester (e.g., lower alkyl ester, benzyl ester), aryl ester, substituted aryl ester), cyano, thioester, thioether, sulfonyl halide, alcohol, thiol, succinimidyl ester, isothiocyanate, iodoacetamide, maleimide, hydrazine, alkynyl, alkenyl, and the like. A reactive group may facilitate covalent attachment of a molecule of interest. Suitable molecules of interest may include, but are not limited to, a detectable label; imaging agents; a toxin (including cytotoxins); a linker; a peptide; a drug (e.g., small molecule drugs); a member of a specific binding pair; an epitope tag; ligands for binding by a target receptor; tags to aid in purification; molecules that increase solubility; molecules that enhance bioavailability; molecules that increase in vivo half-life; molecules that target to a particular cell type; molecules that target to a particular tissue; molecules that provide for crossing the blood-brain barrier; molecules to facilitate selective attachment to a surface; and the like. Functional and reactive groups may be unsubstituted or substituted with one or more functional or reactive groups.

A cannabinoid derivative or olivetolic acid derivative may also refer to a compound lacking one or more chemical moieties found in naturally-occurring cannabinoids or olivetolic acid, yet retains the core structural features (e.g., cyclic core) of a naturally-occurring cannabinoid or olivetolic acid. Such chemical moieties may include, but are not limited to, methyl, alkyl, alkenyl, methoxy, alkoxy, acetyl, carboxyl, carbonyl, oxo, ester, hydroxyl, and the like. In some embodiments, a cannabinoid derivative or olivetolic acid derivative may also comprise one or more of any of the functional and/or reactive groups described herein. Functional and reactive groups may be unsubstituted or substituted with one or more functional or reactive groups.

The term "nucleic acid" or "nucleic acids" used herein, may refer to a polymeric form of nucleotides of any length, either ribonucleotides or deoxynucleotides. Thus, this term may include, but is not limited to, single-, double-, or multi-stranded DNA or RNA, genomic DNA, cDNA, genes, synthetic DNA or RNA, DNA-RNA hybrids, or a polymer comprising purine and pyrimidine bases or other naturally-occurring, chemically or biochemically modified, non-naturally-occurring, or derivatized nucleotide bases.

The terms "peptide," "polypeptide," and "protein" may be used interchangeably herein, and may refer to a polymeric form of amino acids of any length, which can include coded and non-coded amino acids and chemically or biochemically modified or derivatized amino acids. The polypeptides disclosed herein may include full-length polypeptides, fragments of polypeptides, truncated polypeptides, fusion polypeptides, or polypeptides having modified peptide backbones. The polypeptides disclosed herein may also be variants differing from a specifically recited "reference" polypeptide (e.g., a wild-type polypeptide) by amino acid insertions, deletions, mutations, and/or substitutions.

An "engineered variant of a cannabidiolic acid synthase polypeptide" or "engineered variant of the disclosure" may indicate a non-wild type polypeptide having cannabidiolic acid synthase activity. One skilled in the art can measure the cannabidiolic acid synthase activity of the engineered variants using known methods. For example, by GC-MS or LC-MS or as described in the examples provided herein. Engineered variants may have amino acid substitutions compared to a wild type cannabidiolic acid synthase sequence, such as the cannabidiolic acid synthase polypeptide having an amino acid sequence of SEQ ID NO:3. In addition to substitutions, engineered variants may comprise truncations, additions, and/or deletions, and/or other mutations compared to a wild type cannabidiolic acid synthase sequence, such as the cannabidiolic acid synthase polypeptide having an amino acid sequence of SEQ ID NO:3. Engineered variants may have substitutions compared a non-wild type cannabidiolic acid synthase sequence. In addition to substitutions, engineered variants may comprise truncations, additions, and/or deletions and/or other mutations compared to a non-wild type cannabidiolic acid synthase sequence. The engineered variants described herein contain at least one amino acid residue substitution from a parent cannabidiolic acid synthase polypeptide. In some embodiments, the parent cannabidiolic acid synthase polypeptide is a wild type sequence. In some embodiments, the parent cannabidiolic acid synthase polypeptide is a non-wild type sequence.

As used herein, the term "heterologous" may refer to what is not normally found in nature. The term "heterologous nucleotide sequence" or the term "heterologous nucleic acid" may refer to a nucleic acid or nucleotide sequence not normally found in a given cell in nature. A heterologous nucleotide sequence may be: (a) foreign to its host cell (i.e., is "exogenous" to the cell); (b) naturally found in the host cell (i.e., "endogenous") but present at an unnatural quantity in the cell (i.e., greater or lesser quantity than naturally found in the host cell); (c) be naturally found in the host cell but positioned outside of its natural locus; or (d) be naturally found in the host cell, but with introns removed or added. A heterologous nucleic acid may be: (a) foreign to its host cell (i.e., is "exogenous" to the cell); (b) naturally found in the host cell (i.e., "endogenous") but present at an unnatural quantity in the cell (i.e., greater or lesser quantity than naturally found in the host cell); or (c) be naturally found in the host cell but positioned outside of its natural locus. In some embodiments, a heterologous nucleic acid may comprise a codon-optimized nucleotide sequence. A codon-optimized nucleotide sequence may be an example of a heterologous nucleotide sequence. In some embodiments, the heterologous nucleic acids disclosed herein may comprise nucleotide sequences that encode a polypeptide disclosed herein, such as an engineered variant of the disclosure, but do not comprise nucleotide sequences that do not encode the polypeptide disclosed herein (e.g., vector sequences, promoters, enhancers, upstream or downstream elements). In some embodiments, the heterologous nucleic acids disclosed herein may comprise nucleotide sequences encoding a polypeptide disclosed herein, such as an engineered variant of the disclosure, along with nucleotide sequences that do not encode the polypeptide disclosed herein (e.g., vector sequences, promoters, enhancers, upstream or downstream elements).

The term "heterologous enzyme" or "heterologous polypeptide" may refer to an enzyme or polypeptide that is not normally found in a given cell in nature. The term encompasses an enzyme or polypeptide that is: (a) exogenous to a given cell (i.e., encoded by a nucleic acid that is not naturally present in the host cell or not naturally present in a given context in the host cell); or (b) naturally found in the host cell (e.g., the enzyme or polypeptide is encoded by a nucleic acid that is endogenous to the cell) but that is produced in an unnatural amount (e.g., greater or lesser than that naturally found) in the host cell. For example, a heterologous polypeptide may include a mutated version of a polypeptide naturally occurring in a host cell.

As used herein, the term "one or more heterologous nucleic acids" or "one or more heterologous nucleotide sequences" may refer to heterologous nucleic acids comprising one or more nucleotide sequences encoding one or more polypeptides. In some embodiments, the one or more heterologous nucleic acids may comprise a nucleotide sequence encoding one polypeptide. In other embodiments, the one or more heterologous nucleic acids may comprise nucleotide sequences encoding more than one polypeptide. In certain such embodiments, the nucleotide sequences encoding the more than one polypeptide may be present on the same heterologous nucleic acid or on different heterologous nucleic acids, or combinations thereof. In some embodiments, the one or more heterologous nucleic acids may comprise nucleotide sequences encoding multiple copies of the same polypeptide. In certain such embodiments, the nucleotide sequences encoding the multiple copies of the same polypeptide may be present on the same heterologous nucleic acid or on different heterologous nucleic acids, or combinations thereof. In some embodiments, the one or more heterologous nucleic acids may comprise nucleotide sequences encoding multiple copies of different polypeptides. In certain such embodiments, the nucleotide sequences encoding the multiple copies of the different polypeptides may be present on the same heterologous nucleic acid or on different heterologous nucleic acids, or combinations thereof.

As used herein, "increased ratio" may refer to an increase in the molar ratio, an increase in the mass (or weight) ratio, an increase in the molarity ratio, or an increase in the mass concentration (e.g., mg/L or mg/mL) ratio between two products produced by a polypeptide, engineered variant, method, and/or modified host cell disclosed herein compared to the molar ratio, mass (or weight) ratio, molarity ratio, or mass concentration ratio between the same two products produced by another polypeptide, engineered variant, method, and/or modified host cell disclosed herein (e.g., a comparative polypeptide, engineered variant, method, and/or modified host cell disclosed herein). For example, a 100:1 ratio of CBDA over THCA produced by an engineered variant disclosed herein would be an increased ratio of CBDA over THCA compared to an 11:1 ratio of CBDA over THCA produced by a different engineered variant disclosed herein.

As used herein, a ratio of products produced by a polypeptide, engineered variant, method, and/or modified host cell disclosed herein, such as the ratio of CBDA over THCA, may refer to a molar ratio, a mass (or weight) ratio, molarity ratio, or a mass concentration (e.g., mg/L or mg/mL) ratio. For example, if a modified host cell disclosed herein produced 4 mM CBDA and 1 mM THCA, the ratio of CBDA over THCA would be 4:1.

"Operably linked" may refer to an arrangement of elements wherein the components so described are configured so as to perform their usual function. Thus, control sequences operably linked to a coding sequence are capable of effecting the expression of the coding sequence. The control sequences need not be contiguous with the coding sequence, so long as they function to direct the expression thereof. Thus, for example, intervening untranslated yet transcribed sequences can be present between a promoter sequence and the coding sequence and the promoter sequence can still be considered "operably linked" to the coding sequence.

"Isolated" may refer to polypeptides or nucleic acids that are substantially or essentially free from components that normally accompany them in their natural state. An isolated polypeptide or nucleic acid may be other than in the form or setting in which it is found in nature. Isolated polypeptides and nucleic acids therefore may be distinguished from the polypeptides and nucleic acids as they exist in natural cells. An isolated nucleic acid or polypeptide may further be purified from one or more other components in a mixture with the isolated nucleic acid or polypeptide, if such components are present.

A "modified host cell" (also may be referred to as a "recombinant host cell") may refer to a host cell into which has been introduced a nucleic acid (e.g., a heterologous nucleic acid), e.g., an expression vector or construct. For example, a modified eukaryotic host cell may be produced through introduction into a suitable eukaryotic host cell of a nucleic acid (e.g., a heterologous nucleic acid).

As used herein, a "cell-free system" may refer to a cell lysate, cell extract or other preparation in which substantially all of the cells in the preparation have been disrupted or otherwise processed so that all or selected cellular components, e.g., organelles, proteins, nucleic acids, the cell membrane itself (or fragments or components thereof), or the like, are released from the cell or resuspended into an appropriate medium and/or purified from the cellular milieu. Cell-free systems can include reaction mixtures prepared from purified and/or isolated polypeptides and suitable reagents and buffers.

In some embodiments, conservative substitutions may be made in the amino acid sequence of a polypeptide without disrupting the three-dimensional structure or function of the polypeptide. Conservative substitutions may be accomplished by the skilled artisan by substituting amino acids with similar hydrophobicity, polarity, and R-chain length for one another. Additionally, by comparing aligned sequences of homologous proteins from different species, conservative substitutions may be identified by locating amino acid residues that have been mutated between species without altering the basic functions of the encoded proteins. The term "conservative amino acid substitution" may refer to the interchangeability in proteins of amino acid residues having similar side chains. For example, a group of amino acids having aliphatic side chains may consist of glycine, alanine, valine, leucine, and isoleucine; a group of amino acids having aliphatic-hydroxyl side chains may consist of serine and threonine; a group of amino acids having amide containing side chains may consist of asparagine and glutamine; a group of amino acids having aromatic side chains may consist of phenylalanine, tyrosine, and tryptophan; a group of amino acids having basic side chains may consist of lysine, arginine, and histidine; a group of amino acids having acidic side chains may consist of glutamate and aspartate; and a group of amino acids having sulfur containing side chains may consist of cysteine and methionine. Exemplary conservative amino acid substitution groups are: valine-leucine-isoleucine, phenylalanine-tyrosine, lysine-arginine, alanine-valine, and asparagine-glutamine.

A polynucleotide or polypeptide has a certain percent "sequence identity" to another polynucleotide or polypeptide, meaning that, when aligned, that percentage of bases or amino acids are the same, and in the same relative position, when comparing the two sequences. Sequence identity can be determined in a number of different manners. To determine sequence identity, sequences can be aligned using various methods and computer programs (e.g., BLAST, T-COFFEE, MUSCLE, MAFFT, etc.), available over the world wide web at sites including ncbi.nlm.nili.gov/BLAST, ebi.ac.uk/Tools/msa/tcoffee/ebi.ac.uk/Tools/msa/muscle/ mafft.cbrc.jp/alignment/software/. See, e.g., Altschul et al. (1990), J. Mol. Biol. 215:403-10.

Before the present disclosure is further described, it is to be understood that this disclosure is not limited to particular embodiments described, as such may, of course, vary. It is also to be understood that the terminology used herein is for the purpose of describing particular embodiments only, and is not intended to be limiting.

Where a range of values is provided, it is understood that each intervening value, to the tenth of the unit of the lower limit unless the context clearly dictates otherwise, between the upper and lower limit of that range and any other stated or intervening value in that stated range, is encompassed within the disclosure. The upper and lower limits of these smaller ranges may independently be included in the smaller ranges, and are also encompassed within the disclosure, subject to any specifically excluded limit in the stated range. Where the stated range includes one or both of the limits, ranges excluding either or both of those included limits are also included in the disclosure.

Unless defined otherwise, all technical and scientific terms used herein have the same meaning as commonly understood by one of ordinary skill in the art to which this disclosure belongs. Although any methods and materials similar or equivalent to those described herein can also be used in the practice or testing of the present disclosure, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" may include plural referents unless the context clearly dictates otherwise. Thus, for example, reference to "a cannabinoid compound" or "cannabinoid" may include a plurality of such compounds and reference to "the modified host cell" may include reference to one or more modified host cells and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

It is appreciated that certain features of the disclosure, which are, for clarity, described in the context of separate embodiments, may also be provided in combination in a single embodiment. Conversely, various features of the disclosure, which are, for brevity, described in the context of a single embodiment, may also be provided separately or in any suitable sub-combination. All combinations of the embodiments pertaining to the disclosure are specifically embraced by the present disclosure and are disclosed herein just as if each and every combination was individually and explicitly disclosed. In addition, all sub-combinations of the various embodiments and elements thereof are also specifically embraced by the present disclosure and are disclosed herein just as if each and every such sub-combination was individually and explicitly disclosed herein.

Engineered Variants of the Cannabidiolic Acid Synthase (CBDAS) Polypeptide

Disclosed herein are engineered variants of a cannabidiolic acid synthase (CBDAS) polypeptide comprising an amino acid sequence of SEQ ID NO:3 with one or more amino acid substitutions. The inventors have identified amino acid locations of the CBDAS polypeptide comprising an amino acid sequence of SEQ ID NO:3 that when substituted, may result in one or more improved properties of the engineered variant. In one aspect of the disclosure, the substitution is at a location corresponding to the position in the CBDAS polypeptide of SEQ ID NO:3 from *Cannabis sativa*. The CBDAS polypeptide of SEQ ID NO:3 from *Cannabis sativa* comprises the following domains:

1. Signal polypeptide: amino acids 1-28.
2. FAD binding domain: amino acids 77-251.
3. BBE domain: amino acids 479-537.

The CBDAS polypeptide of SEQ ID NO:3 from *Cannabis sativa* also comprises the following domains surface exposed amino acids: 28-33, 35, 36, 39-45, 47-50, 52, 55-59, 61, 62, 65, 66, 69, 71-77, 79, 80, 82, 88, 89, 90, 94, 98, 101, 102, 104, 109, 114, 115, 124, 125, 126, 133, 134, 136-139, 141-145, 148, 150, 161, 164-168, 176, 183, 197, 202, 205, 208, 213, 215-221, 223, 224, 225, 231, 236, 245, 247, 250, 252, 253, 258, 260, 261-267, 270, 273, 274, 277, 278, 280, 281, 283, 284, 285, 291, 293, 295-305, 311, 317, 320, 321, 322, 325, 326, 328, 329, 330, 332, 333, 335, 337-340, 342, 343, 348, 355, 357-367, 370-373, 376, 377, 388, 389, 390, 392, 393, 394, 398, 401, 402, 404, 405, 407, 408, 409, 412, 421, 423-429, 436, 437, 443, 445, 447, 449, 450-453, 455, 456, 459, 462, 463, 466, 467, 469, 470, 471, 474-477, 482, 483, 486, 487, 490, 492-501, 503, 504, 507, 508, 512, 515, 516, 519, 523, 524, 526, 527, 529, 531, and 539-544.

Residue positions in the engineered variants discussed herein are identified with respect to a reference amino acid sequence, the CBDAS polypeptide of SEQ ID NO:3 from *Cannabis sativa* (shown herein in Table 1; UniProtKB/Swiss-Prot: A6P6V9.1). Accordingly, a reference to "K165" identifies an amino acid that, in the CBDAS polypeptide of SEQ ID NO:3 from *Cannabis sativa*, is the 165$^{th}$ amino acid from the N-terminus, wherein the methionine is the first amino acid. The 165$^{th}$ amino acid is a lysine (K) in the CBDAS polypeptide of SEQ ID NO:3 from *Cannabis sativa*. Those of skill in the art appreciate that the K165 amino acid may have a different position in the CBDAS polypeptides from different species or in different isoforms. These engineered variants are intended to be encompassed by this disclosure.

The polypeptide sequence position at which a particular amino acid or amino acid change ("residue difference") is present is sometimes described herein as "Xn", or "position n", where n refers to the amino acid position with respect to the reference sequence. Accordingly, a reference to "X165" identifies an amino acid that, in the CBDAS polypeptide of SEQ ID NO:3 from *Cannabis sativa*, is the 165$^{th}$ amino acid from the N-terminus.

A specific substitution mutation, which is a replacement of the specific amino acid in a reference sequence with a different specified residue may be denoted by the conventional notation "X (number)Y", where X is the single letter identifier of the amino in the reference sequence, "number" is the amino acid position in the reference sequence, and Y is the single letter identifier of the amino acid substitution in the engineered sequence. Accordingly, a reference to "K165A" identifies a substitution that, in the CBDAS polypeptide of SEQ ID NO:3 from *Cannabis sativa*, is the 165$^{th}$ amino acid from the N-terminus, lysine, being replaced by alanine.

Cannabinoid synthase polypeptides, secreted polypeptides, have structural features that may hinder expression in modified host cells, such as modified yeast cells. Cannabinoid synthase polypeptides comprise disulfide bonds, numerous glycosylation sites, including N-glycosylation sites, and a bicovalently attached flavin adenine dinucleotide (FAD) cofactor moiety. Accordingly, reconstituting the activity of or expressing cannabinoid synthase polypeptides in a modified host cell, such as a modified yeast cell, can be challenging and unreliable. Often these secreted polypeptides are misfolded or mislocalized, resulting in low expression, polypeptides lacking activity, reduced host cell viability, and/or cell death. As disclosed herein, engineered variants may have improved expression, folding, and enzymatic activity compared to the CBDAS polypeptide comprising an amino acid sequence of SEQ ID NO:3. Additionally, expression of the engineered variants of the disclosure may enhance viability of the modified host cells disclosed herein compared to modified host cells expressing a CBDAS polypeptide comprising an amino acid sequence of SEQ ID NO:3.

The disclosure provides for an engineered variant of a cannabidiolic acid synthase (CBDAS) polypeptide comprising an amino acid sequence of SEQ ID NO:3 with one or more amino acid substitutions. In certain such embodiments, the engineered variant comprises an amino acid sequence with at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to SEQ ID NO:3. In some embodiments, the engineered variant comprises an amino acid sequence with at least 75%, at least 76%, at least 77%, at least 78%, at least 79%, at least 80%, at least 81%, at least 82%, at least 83%, or at least 84% sequence identity to SEQ ID NO:3.

The disclosure provides for an engineered variant of a cannabidiolic acid synthase (CBDAS) polypeptide comprising an amino acid sequence of SEQ ID NO:3 with one or more amino acid substitutions, wherein the engineered variant comprises at least one amino acid substitution in a signal polypeptide, a flavin adenine dinucleotide (FAD) binding domain, a berberine bridge enzyme (BBE) domain, or a combination of the foregoing. In some embodiments, at least one amino acid substitution is present in the signal polypeptide. In certain such embodiments, the engineered variant comprises at least 1, at least 2, at least 3, at least 4, at least 5, at least 6, at least 7, at least 8, at least 9, at least 10, at least 11, at least 12, at least 13, at least 14, or at least 15 amino acid substitutions in the signal polypeptide. In some embodiments, the engineered variant comprises 1, 2, 3, 4, 5, 6, 7, 8, 9, 10, 11, 12, 13, 14, or 15 amino acid substitutions in the signal polypeptide. In some embodiments, wherein at least one amino acid substitution is present in the signal polypeptide, the engineered variant comprises at least one amino acid substitution at an amino acid selected from the group consisting of X12, X17, X18, and X20. In some embodiments, wherein at least one amino acid substitution is present in the signal polypeptide, the engineered variant comprises at least one amino acid substitution at an amino acid selected from the group consisting of C12, F17, F18, and S20. In some embodiments, wherein at least one amino acid substitution is present in the signal polypeptide, the engineered variant comprises at least one amino acid substitution selected from the group consisting of C12F, F17M, F18T, F18W, and S20G. In some embodiments, at least one amino acid substitution is present in the FAD binding domain. In certain such embodiments, the engineered variant comprises at least 1, at least 2, at least 3, at least 4, at least 5, at least 6, at least 7, at least 8, at least 9, at least 10, at least 11, at least 12, at least 13, at least 14, or at least 15 amino acid substitutions in the FAD binding domain. In some embodiments, the engineered variant comprises 1, 2, 3, 4, 5, 6, 7, 8, 9, 10, 11, 12, 13, 14, or 15 amino acid substitutions in the FAD binding domain. In some embodiments, wherein at least one amino acid substitution is present in the FAD domain, the engineered variant comprises at least one amino acid substitution at an amino acid selected from the group consisting of X97, X98, X100, X103, X109, X124, X125, X129, X132, X137, X143, X149, X161, X165, X167, X168, X170, X171, X172, X175, X180, X181, X196, X208, X235, and X250. In some embodiments, wherein at least one amino acid substitution is present in the FAD domain, the engineered variant comprises at least one amino acid substitution at an amino acid selected from the group consisting of 197, L98, S100, V103, T109, Q124, V125, I129, L132, S137, H143, V149, W161, K165, E167, N168, S170, L171, A172, Y175, C180, A181, N196, H208, A235, and A250. In some embodiments, wherein at least one amino acid substitution is present in the FAD domain, the engineered variant comprises at least one amino acid substitution selected from the group consisting of I97V, L98V, S100A, V103A, V103F, T109V, Q124D, Q124E, Q124N, V125E, V125Q, I129V, L132M, S137G, H143D, V149I, W161K, W161R, W161Y, K165A, E167P, N168S, S170T, L171I, A172V, Y175F, C180A, A181V, N196Q, N196T, N196V, H208T, A235P, and A250T. In some embodiments, at least one amino acid substitution is present in the BBE domain. In certain such embodiments, the engineered variant comprises at least 1, at least 2, at least 3, at least 4, at least 5, at least 6, at least 7, at least 8, at least 9, at least 10, at least 11, at least 12, at least 13, at least 14, or at least 15 amino acid substitutions in the BBE domain. In some embodiments, the engineered variant comprises 1, 2, 3, 4, 5, 6, 7, 8, 9, 10, 11, 12, 13, 14, or 15 amino acid substitutions in the BBE domain. In some embodiments, wherein at least one amino acid substitution is present in the BBE domain, the engineered variant comprises at least one amino acid substitution at an amino acid selected from the group consisting of X499 and X527. In some embodiments, wherein at least one amino acid substitution is present in the BBE domain, the engineered variant comprises at least one amino acid substitution at an amino acid selected from the group consisting of Y499 and N527. In some embodiments, wherein at least one amino acid substitution is present in the BBE domain, the engineered variant comprises at least one amino acid substitution selected from the group consisting of Y499M, Y499V, and N527E.

The disclosure provides for an engineered variant of a cannabidiolic acid synthase (CBDAS) polypeptide comprising an amino acid sequence of SEQ ID NO:3 with one or more amino acid substitutions, wherein the engineered variant comprises substitution of at least one surface exposed amino acid. In certain such embodiments, at least one hydrophobic surface exposed amino acid is substituted with a hydrophilic amino acid. In some embodiments, at least one hydrophilic surface exposed amino acid is substituted with a hydrophobic amino acid. In some embodiments, the engineered variant comprises substitution of at least 1, at least 2, at least 3, at least 4, at least 5, at least 6, at least 7, at least 8, at least 9, at least 10, at least 11, at least 12, at least 13, at least 14, or at least 15 surface exposed amino acids. In some embodiments, the engineered variant comprises substitution of 1, 2, 3, 4, 5, 6, 7, 8, 9, 10, 11, 12, 13, 14, or 15 surface exposed amino acids. In some embodiments, wherein the engineered variant comprises substitution of at least one surface exposed amino acid, the engineered variant comprises at least one amino acid substitution selected from the group consisting of X31, X43, X49, X50, X55, X56, X57, X61, X62, X71, X109, X124, X125, X137, X143, X161, X165, X167, X168, X208, X250, X260, X326, X389, X428, X466, X499, X527, X541, X542, X543, and X544. In some embodiments, wherein the engineered variant comprises substitution of at least one surface exposed amino acid, the engineered variant comprises at least one amino acid substitution selected from the group consisting of X31, X43, X49, X50, X55, X56, X57, X61, X62, X71, X109, X124, X125, X137, X143, X161, X165, X167, X168, X208, X250, X260, X326, X389, X412, X428, X445, X466, X499, X527, X541, X542, X543, and X544. In some embodiments, wherein the engineered variant comprises substitution of at least one surface exposed amino acid, the engineered variant comprises at least one amino acid substitution selected from the group consisting of R31, P43, L49, K50, Q55, N56, N57, M61, S62, L71, T109, Q124, V125, S137, H143, W161, K165, E167, N168, H208, A250, K260, L326, K389, S428, N466, Y499, N527, R541, H542, R543, and H544. In some embodiments, wherein the engineered variant comprises substitution of at least one surface exposed amino acid, the engineered variant comprises at least one amino acid substitution selected from the group consisting of R31, P43, L49, K50, Q55, N56, N57, M61, S62, L71, T109, Q124, V125, S137, H143, W161, K165, E167, N168, H208, A250, K260, L326, K389, M412, S428, I445, N466, Y499, N527, R541, H542, R543, and H544. In some embodiments, wherein the engineered variant comprises substitution of at least one surface exposed amino acid, the engineered variant comprises at least one amino acid substitution selected from the group consisting of R31Q, P43E, L49E, L49K, L49Q, K50T, Q55E, Q55P, N56E, N57D, N57E, M61H, M61S, M61W, S62N, S62Q, L71A, L71H, L71Q, T109V, Q124D, Q124E, Q124N, V125E, V125Q, S137G, H143D, W161K, W161R, W161Y, K165A, E167P, N168S, H208T, A250T, K260C, K260W, L326I, K389E, S428L, N466D, Y499M, Y499V, N527E, R541E, R541V, H542V, R543A, R543E, H544E, and H544D. In some embodiments, wherein the engineered variant comprises substitution of at least one surface exposed amino acid, the engineered variant comprises at least one amino acid substitution selected from the group consisting of R31Q, P43E, L49E, L49K, L49Q, K50T, Q55E, Q55P, N56E, N57D, N57E, M61H, M61S, M61W, S62N, S62Q, L71A, L71H, L71Q, T109V, Q124D, Q124E, Q124N, V125E, V125Q, S137G, H143D, W161K, W161R, W161Y, K165A, E167P, N168S, H208T, A250T, K260C, K260W, L326I, K389E, M412Q, S428L, I445M, N466D, Y499M, Y499V, N527E, R541E, R541V, H542V, R543A, R543E, H544E, and H544D. Substitution of hydrophobic surface exposed amino acids with hydrophilic amino acids may increase the hydrophilicity of solvent-exposed amino acids, which may improve solubility of the engineered variants of the disclosure in an aqueous (non-trichome) environment.

The disclosure provides for an engineered variant, wherein the engineered variant comprises at least one amino acid substitution at an amino acid selected from the group consisting of X12, X17, X18, X20, X31, X33, X43, X49, X50, X51, X55, X56, X57, X59, X61, X62, X63, X66, X71, X75, X97, X98, X100, X103, X109, X124, X125, X129, X132, X137, X143, X149, X161, X165, X167, X168, X170, X171, X172, X175, X180, X181, X196, X208, X235, X250, X256, X260, X268, X309, X310, X316, X326, X378, X389, X406, X428, X439, X466, X474, X499, X527, X538, X541, X542, X543, and X544. In some embodiments, the engineered variant comprises at least one amino acid substitution at an amino acid selected from the group consisting of X12, X17, X18, X20, X31, X33, X43, X49, X50, X51, X55, X56, X57, X59, X61, X62, X63, X66, X71, X75, X97, X98, X100, X103, X109, X124, X125, X129, X132, X137, X143, X149, X161, X165, X167, X168, X170, X171, X172, X175, X180, X181, X196, X208, X235, X250, X256, X260, X268, X309, X310, X316, X326, X378, X389, X406, X412, X415, X428, X439, X445, X466, X474, X499, X527, X538, X541, X542, X543, and X544. In some embodiments, the engineered variant comprises at least one amino acid substitution at an amino acid selected from the group consisting of X31, X43, X49, X50, X51, X55, X56, X57, X61, X62, X71, X97, X100, X103, X109, X124, X125, X129, X132, X137, X143, X149, X161, X165, X167, X168, X170, X171, X172, X175, X180, X181, X196, X208, X235, X250, X256, X260, X268, X309, X310, X316, X326, X378, X389, X428, X439, X466, X474, X499, X527, X538, X541, X542, X543, and X544. In certain such embodiments, the engineered variant comprises at least one amino acid substitution at an amino acid selected from the group consisting of X49, X50, X56, X57, X125, X132, X149, X161, X165, X170, X171, X172, X196, X235, X260, X268, X310, X316, X326, X378, X428, X499, X527, X543, and X544. In some embodiments, the engineered variant comprises at least one amino acid substitution at an amino acid selected from the group consisting of X31, X43, X49, X50, X56, X57, X71, X100, X103, X109, X124, X125, X129, X132, X137, X143, X161, X165, X167, X168, X170, X171, X172, X175, X180, X181, X196, X208, X235, X250, X256, X260, X268, X309, X310, X316, X326, X378, X389, X406, X428, X439, X466, X474, X499, X527, X541, X542, X543, and X544. Such engineered variants may produce CBDA from CBGA in a greater amount, as measured in mg/L or mM, than an amount of CBDA produced from CBGA by a cannabidiolic acid synthase polypeptide having an amino acid sequence of SEQ ID NO:3 under similar conditions for the same length of time.

The disclosure provides for an engineered variant, wherein the engineered variant comprises at least one amino acid substitution at an amino acid selected from the group consisting of X31, X57, X61, X71, X170, X172, X175, X196, X208, X235, X260, X378, X389, and X543. In certain such embodiments, the engineered variant comprises at least one amino acid substitution at an amino acid selected from the group consisting of X57, X170, X172, X196, X235, X260, and X378. In some embodiments, the engineered variant comprises at least one amino acid substitution at an amino acid selected from the group consisting of X412, X415, and X445. In some embodiments, the engineered variant comprises an amino acid substitution at amino acid X445. Such engineered variants may produce CBDA from CBGA in a greater amount, as measured in mg/L or mM, than an amount of CBDA produced from CBGA by a cannabidiolic acid synthase polypeptide having an amino acid sequence of SEQ ID NO:3 under similar conditions for the same length of time and/or may produce CBDA from CBGA in an increased ratio of CBDA over THCA compared to that produced by a cannabidiolic acid synthase polypeptide having an amino acid sequence of SEQ ID NO:3 under similar conditions for the same length of time. In some embodiments, such engineered variants may produce CBDA from CBGA in an increased ratio of CBDA over CBCA compared to that produced by a cannabidiolic acid synthase polypeptide having an amino acid sequence of SEQ ID NO:3 under similar conditions for the same length of time.

The disclosure provides for an engineered variant, wherein the engineered variant comprises at least one amino acid substitution at an amino acid selected from the group consisting of C12, F17, F18, S20, R31, N33, P43, L49, K50, L51, Q55, N56, N57, L59, M61, S62, V63, S66, L71, S75, I97, L98, S100, V103, T109, Q124, V125, I129, L132, S137, H143, V149, W161, K165, E167, N168, S170, L171, A172, Y175, C180, A181, N196, H208, A235, A250, M256, K260, L268, H309, T310, F316, L326, G378, K389, E406, S428, L439, N466, K474, Y499, N527, P538, R541, H542, R543, and H544. In some embodiments, the engineered variant comprises at least one amino acid substitution at an amino acid selected from the group consisting of C12, F17, F18, S20, R31, N33, P43, L49, K50, L51, Q55, N56, N57, L59, M61, S62, V63, S66, L71, S75, I97, L98, S100, V103, T109, Q124, V125, I129, L132, S137, H143, V149, W161, K165, E167, N168, S170, L171, A172, Y175, C180, A181, N196, H208, A235, A250, M256, K260, L268, H309, T310, F316, L326, G378, K389, E406, M412, L415, S428, L439, I445, N466, K474, Y499, N527, P538, R541, H542, R543, and H544. In some embodiments, the engineered variant comprises at least one amino acid substitution at an amino acid selected from the group consisting of R31, P43, L49, K50, L51, Q55, N56, N57, M61, S62, L71, I97, S100, V103, T109, Q124, V125, I129, L132, S137, H143, V149, W161, K165, E167, N168, S170, L171, A172, Y175, C180, A181, N196, H208, A235, A250, M256, K260, L268, H309, T310, F316, L326, G378, K389, S428, L439, N466, K474, Y499, N527, P538, R541, H542, R543, and H544. In certain such embodiments, the engineered variant comprises at least one amino acid substitution at an amino acid selected from the group consisting of L49, K50, N56, N57, V125, L132, V149, W161, K165, S170, L171, A172, N196, A235, K260, L268, T310, F316, L326, G378, S428, Y499, N527, H543, and H544. In some embodiments, the engineered variant comprises at least one amino acid substitution at an amino acid selected from the group consisting of R31, P43, L49, K50, N56, N57, L71, S100, V103, T109, Q124, V125, 1129, L132, S137, H143, W161, K165, E167, N168, S170, L171, A172, Y175, C180, A181, N196, H208, A235, A250, M256, K260, L268, H309, T310, F316, L326, G378, K389, E406, S428, L439, N466, K474, Y499, N527, R541, H542, R543, and H544. Such engineered variants may produce CBDA from CBGA in a greater amount, as measured in mg/L or mM, than an amount of CBDA produced from CBGA by a cannabidiolic acid synthase polypeptide having an amino acid sequence of SEQ ID NO:3 under similar conditions for the same length of time.

The disclosure provides for an engineered variant, wherein the engineered variant comprises at least one amino acid substitution at an amino acid selected from the group consisting of R31, N57, M61, L71, S170, A172, Y175, N196, H208, A235, K260, G378, K389, and R543. In certain such embodiments, the engineered variant comprises at least one amino acid substitution at an amino acid selected from the group consisting of N57, S170, A172, N196, A235, K260, and G378. In some embodiments, the engineered variant comprises at least one amino acid substitution at an amino acid selected from the group consisting of M412, L415, and I445. In some embodiments, the engineered variant comprises an amino acid substitution at amino acid I445. Such engineered variants may produce CBDA from CBGA in a greater amount, as measured in mg/L or mM, than an amount of CBDA produced from CBGA by a cannabidiolic acid synthase polypeptide having an amino acid sequence of SEQ ID NO:3 under similar conditions for the same length of time and/or may produce CBDA from CBGA in an increased ratio of CBDA over THCA compared to that produced by a cannabidiolic acid synthase polypeptide having an amino acid sequence of SEQ ID NO:3 under similar conditions for the same length of time. In some embodiments, such engineered variants may produce CBDA from CBGA in an increased ratio of CBDA over CBCA compared to that produced by a cannabidiolic acid synthase polypeptide having an amino acid sequence of SEQ ID NO:3 under similar conditions for the same length of time.

The disclosure provides for an engineered variant, wherein the engineered variant comprises at least one amino acid substitution selected from the group consisting of C12F, F17M, F18T, F18W, 520G, R31Q, N33K, P43E, L49E, L49K, L49Q, K50T, L51I, Q55E, Q55P, N56E, N57D, N57E, L59E, M61H, M61S, M61W, S62N, S62Q, V63M, S66D, L71A, L71H, L71Q, S75D, S75E, I97V, L98V, S100A, V103A, V103F, T109V, Q124D, Q124E, Q124N, V125E, V125Q, I129V, L132M, S137G, H143D, V149I, W161K, W161R, W161Y, K165A, E167P, N168S, S170T, L171I, A172V, Y175F, C180A, A181V, N196Q, N196T, N196V, H208T, A235P, A250T, M256V, K260C, K260W, L268I, H309V, T310A, T310C, F316Y, L326I, G378T, G3785, K389E, E406K, S428L, L439M, N466D, K474S, Y499M, Y499V, N527E, P538T, R541E, R541V, H542V, R543A, R543E, H544E, and H544D. In some embodiments, the engineered variant comprises at least one amino acid substitution selected from the group consisting of C12F, F17M, F18T, F18W, 520G, R31Q, N33K, P43E, L49E, L49K, L49Q, K50T, L51I, Q55E, Q55P, N56E, N57D, N57E, L59E, M61H, M61S, M61W, S62N, S62Q, V63M, S66D, L71A, L71H, L71Q, S75D, S75E, I97V, L98V, S100A, V103A, V103F, T109V, Q124D, Q124E, Q124N, V125E, V125Q, I129V, L132M, S137G, H143D, V149I, W161K, W161R, W161Y, K165A, E167P, N168S, S170T, L171I, A172V, Y175F, C180A, A181V, N196Q, N196T, N196V, H208T, A235P, A250T, M256V, K260C, K260W, L268I, H309V, T310A, T310C, F316Y, L326I, G378T, G378S, K389E, E406K, M412Q, L415M, S428L, L439M, I445M, N466D, K474S, Y499M, Y499V, N527E, P538T, R541E, R541V, H542V, R543A, R543E, H544E, and H544D. In some embodiments, the engineered variant comprises at least one amino acid substitution selected from the group consisting of R31Q, P43E, L49E, L49K, L49Q, K50T, L51I, Q55E, Q55P, N56E, N57D, M61H, M61S, M61W, S62Q, L71A, L71Q, I97V, S100A, V103A, V103F, T109V, Q124D, Q124E, Q124N, V125E, V125Q, I129V, L132M, S137G, H143D, V149I, W161K, W161R, W161Y, K165A, E167P, N168S, S170T, L171I, A172V, Y175F, C180A, A181V, N196Q, N196T, N196V, H208T, A235P, A250T, M256V, K260C, K260W, L268I, H309V, T310A, T310C, F316Y, L326I, G378T, G378S, K389E, S428L, L439M, N466D, K474S, Y499M, Y499V, N527E, P538T, R541E, R541V, H542V, R543A, R543E, H544E, and H544D. In certain such embodiments, the engineered variant comprises at least one amino acid substitution selected from the group consisting of L49E, L49Q, K50T, N56E, N57D, V125E, L132M, V149I, W161R, K165A, S170T, L171I, A172V, N196Q, N196T, N196V, A235P, K260W, K260C, L268I, T310A, T310C, F316Y, L326I, G378T, S428L, Y499M, Y499V, N527E, H543E, and H544E. In some embodiments, the engineered variant comprises at least one amino acid substitution selected from the group consisting of R31Q, P43E, L49E, L49Q, L49K, K50T, N56E, N57D, L71Q, L71H, L71A, S100A, V103F, V103A, T109V, Q124D, V125E, V125Q, I129V, L132M, S137G, H143D, W161R, W161K, W161Y, K165A, E167P, N168S, S170T, L171I, A172V, Y175F, C180A, A181V, N196Q, N196T, N196V, H208T, A235P, A250T, M256V, K260W, K260C, L268I, H309V, T310A, T310C, F316Y, L326I, G378T, G378S, K389E, E406K, S428L, L439M, N466D, K474S, Y499V, Y499M, N527E, R541V, H542V, R543E, R543A, H544D, and H544E. Such engineered variants may produce CBDA from CBGA in a greater amount, as measured in mg/L or mM, than an amount of CBDA produced from CBGA by a cannabidiolic acid synthase polypeptide having an amino acid sequence of SEQ ID NO:3 under similar conditions for the same length of time.

The disclosure provides for an engineered variant, wherein the engineered variant comprises at least one amino acid substitution selected from the group consisting of R31Q, N57D, M61W, L71H, S170T, A172V, Y175F, N196V, H208T, A235P, K260W, G378T, K389E, and R543E. In certain such embodiments, the engineered variant comprises at least one amino acid substitution selected from the group consisting of N57D, S170T, A172V, N196V, A235P, K260W, and G378T. In some embodiments, the engineered variant comprises at least one amino acid substitution selected from the group consisting of M412Q, L415M, and I445M. In some embodiments, the engineered variant comprises amino acid substitution I445M. Such engineered variants may produce CBDA from CBGA in a greater amount, as measured in mg/L or mM, than an amount of CBDA produced from CBGA by a cannabidiolic acid synthase polypeptide having an amino acid sequence of SEQ ID NO:3 under similar conditions for the same length of time and/or may produce CBDA from CBGA in an increased ratio of CBDA over THCA compared to that produced by a cannabidiolic acid synthase polypeptide having an amino acid sequence of SEQ ID NO:3 under similar conditions for the same length of time. In some embodiments, such engineered variants may produce CBDA from CBGA in an increased ratio of CBDA over CBCA compared to that produced by a cannabidiolic acid synthase polypeptide having an amino acid sequence of SEQ ID NO:3 under similar conditions for the same length of time.

The disclosure provides for an engineered variant, wherein the engineered variant comprises an amino acid sequence selected from the group consisting of SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, and SEQ ID NO:234. In some embodiments, the engineered variant comprises an amino acid sequence selected from the group consisting of SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:300, SEQ ID NO:302, and SEQ ID NO:304. In some embodiments, the engineered variant comprises an amino acid sequence selected from the group consisting of SEQ ID NO:60, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:88, SEQ ID NO:90, SEQ ID NO:92, SEQ ID NO:96, SEQ ID NO:102, SEQ ID NO:106, SEQ ID NO:112, SEQ ID NO: 116, SEQ ID NO: 118, SEQ ID NO:120, SEQ ID NO:122, SEQ ID NO: 124, SEQ ID NO:126, SEQ ID NO:128, SEQ ID NO:130, SEQ ID NO:132, SEQ ID NO: 134, SEQ ID NO:136, SEQ ID NO:138, SEQ ID NO:140, SEQ ID NO:142, SEQ ID NO: 144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO: 164, SEQ ID NO:166, SEQ ID NO:168, SEQ ID NO:170, SEQ ID NO:172, SEQ ID NO: 174, SEQ ID NO:176, SEQ ID NO:178, SEQ ID NO:180, SEQ ID NO:182, SEQ ID NO: 184, SEQ ID NO:186, SEQ ID NO:188, SEQ ID NO:190, SEQ ID NO:192, SEQ ID NO: 194, SEQ ID NO:196, SEQ ID NO:198, SEQ ID NO:200, SEQ ID NO:202, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, and SEQ ID NO:234. In certain such embodiments, the engineered variant comprises an amino acid sequence selected from the group consisting of SEQ ID NO:66, SEQ ID NO:70, SEQ ID NO:72, SEQ ID NO:80, SEQ ID NO:82, SEQ ID NO:130, SEQ ID NO:136, SEQ ID NO:142, SEQ ID NO:146, SEQ ID NO:150, SEQ ID NO:156, SEQ ID NO:158, SEQ ID NO:160, SEQ ID NO:168, SEQ ID NO:170, SEQ ID NO:172, SEQ ID NO:176, SEQ ID NO:182, SEQ ID NO:184, SEQ ID NO:186, SEQ ID NO:190, SEQ ID NO:192, SEQ ID NO:194, SEQ ID NO:196, SEQ ID NO:198, SEQ ID NO:206, SEQ ID NO:214, SEQ ID NO:216, SEQ ID NO:218, SEQ ID NO:230, and SEQ ID NO:232. In some embodiments, the engineered variant comprises an amino acid sequence selected from the group consisting of SEQ ID NO:60, SEQ ID NO:64, SEQ ID NO:66, SEQ ID NO:68, SEQ ID NO:70, SEQ ID NO:72, SEQ ID NO:80, SEQ ID NO:82, SEQ ID NO:102, SEQ ID NO:104, SEQ ID NO:106, SEQ ID NO:116, SEQ ID NO:118, SEQ ID NO:120, SEQ ID NO:122, SEQ ID NO:124, SEQ ID NO:130, SEQ ID NO:132, SEQ ID NO:134, SEQ ID NO:136, SEQ ID NO:138, SEQ ID NO:140, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:224, SEQ ID NO:226, SEQ ID NO:228, SEQ ID NO:230, SEQ ID NO:232, and SEQ ID NO:234. Such engineered variants may produce CBDA from CBGA in a greater amount, as measured in mg/L or mM, than an amount of CBDA produced from CBGA by a cannabidiolic acid synthase polypeptide having an amino acid sequence of SEQ ID NO:3 under similar conditions for the same length of time.

The disclosure provides for an engineered variant, wherein the engineered variant comprises an amino acid sequence selected from the group consisting of SEQ ID NO:60, SEQ ID NO:82, SEQ ID NO:92, SEQ ID NO:104, SEQ ID NO:156, SEQ ID NO:160, SEQ ID NO:162, SEQ ID NO:172, SEQ ID NO:174, SEQ ID NO:176, SEQ ID NO:184, SEQ ID NO:198, SEQ ID NO:202, and SEQ ID NO:230. In certain such embodiments, the engineered variant comprises an amino acid sequence selected from the group consisting of SEQ ID NO:82, SEQ ID NO:156, SEQ ID NO:160, SEQ ID NO:172, SEQ ID NO:176, SEQ ID NO:184, and SEQ ID NO:198. In some embodiments, the engineered variant comprises an amino acid sequence selected from the group consisting of SEQ ID NO:300, SEQ ID NO:302, and SEQ ID NO:304. In some embodiments, the engineered variant comprises an amino acid sequence of SEQ ID NO:300. Such engineered variants may produce CBDA from CBGA in a greater amount, as measured in mg/L or mM, than an amount of CBDA produced from CBGA by a cannabidiolic acid synthase polypeptide having an amino acid sequence of SEQ ID NO:3 under similar conditions for the same length of time and/or may produce CBDA from CBGA in an increased ratio of CBDA over THCA compared to that produced by a cannabidiolic acid synthase polypeptide having an amino acid sequence of SEQ ID NO:3 under similar conditions for the same length of time. In some embodiments, such engineered variants may produce CBDA from CBGA in an increased ratio of CBDA over CBCA compared to that produced by a cannabidiolic acid synthase polypeptide having an amino acid sequence of SEQ ID NO:3 under similar conditions for the same length of time.

The disclosure provides for an engineered variant, wherein the engineered variant comprises an amino acid sequence of SEQ ID NO:3 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, or at least 30 amino acid substitutions. The disclosure provides for an engineered variant, wherein the engineered variant comprises an amino acid sequence of SEQ ID NO:3 with 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 amino acid substitutions. Combinations of the amino acid substitutions described herein can be made and the resulting engineered variants screened for improved cannabidiolic acid synthase (CBDAS) properties. Engineered variants comprising combinations of all of the substitutions described herein are intended to be encompassed by this disclosure. In some embodiments, the engineered variant comprises at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, or at least 30 of the amino acid substitutions described herein. In some embodiments, the engineered variant comprises 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the amino acid substitutions described herein (e.g., 1-30 of the amino acid substitutions described herein). In some embodiments, the engineered variant comprises 1, 2, 3, 4, 5, 6, 7, 8, 9, 10, 11, 12, 13, 14, or 15 of the amino acid substitutions described herein (e.g., 1-15 of the amino acid substitutions described herein). In some embodiments, the engineered variant comprises 1, 2, 3, 4, 5, 6, 7, 8, 9, or 10 of the amino acid substitutions described herein (e.g., 1-10 of the amino acid substitutions described herein). In some embodiments, the engineered variant comprises 1, 2, 3, 4, or 5 of the amino acid substitutions described herein (e.g., 1-5 of the amino acid substitutions described herein). In some embodiments, the engineered variant comprises 1, 2, 3, or 4 of the amino acid substitutions described herein (e.g., 1-4 of the amino acid substitutions described herein). In some embodiments, the engineered variant comprises 1, 2, or 3 of the amino acid substitutions described herein (e.g., 1-3 of the amino acid substitutions described herein). In some embodiments, the engineered variant comprises 1 or 2 of the amino acid substitutions described herein (e.g., 1-2 of the amino acid substitutions described herein). In some embodiments, the engineered variant comprises 1 of the amino acid substitutions described herein. In some embodiments, the engineered variant comprises 2 of the amino acid substitutions described herein. In some embodiments, the engineered variant comprises 3 of the amino acid substitutions described herein. In some embodiments, the engineered variant comprises 4 of the amino acid substitutions described herein. In some embodiments, the engineered variant comprises 5 of the amino acid substitutions described herein.

The disclosure provides for an engineered variant, wherein the engineered variant comprises at least one amino acid substitution at an amino acid selected from the group consisting of X61, X378, and X389. In some embodiments, the engineered variant comprises amino acid substitutions at amino acids X61 and X378. In some embodiments, the engineered variant comprises amino acid substitutions at amino acids X61 and X389. In some embodiments, the engineered variant comprises amino acid substitutions at amino acids X378 and X389. In some embodiments, the engineered variant comprises amino acid substitutions at amino acids X61, X378, and X389. The disclosure provides for an engineered variant, wherein the engineered variant comprises at least one amino acid substitution at an amino acid selected from the group consisting of M61, G378, and K389. In some embodiments, the engineered variant comprises amino acid substitutions at amino acids M61 and G378. In some embodiments, the engineered variant comprises amino acid substitutions at amino acids M61 and K389. In some embodiments, the engineered variant comprises amino acid substitutions at amino acids G378 and K389. In some embodiments, the engineered variant comprises amino acid substitutions at amino acids M61, G378, and K389. The disclosure provides for an engineered variant, wherein the engineered variant comprises at least one amino acid substitution selected from the group consisting of M61W, G378T, and K389E. In some embodiments, the engineered variant comprises amino acid substitutions M61W and G378T. In some embodiments, the engineered variant comprises amino acid substitutions M61W and K389E. In some embodiments, the engineered variant comprises amino acid substitutions G378T and K389E. In some embodiments, the engineered variant comprises amino acid substitutions M61W, G378T, and K389E. The disclosure provides for an engineered variant, wherein the engineered variant comprises an amino acid sequence selected from the group consisting of SEQ ID NO:314, SEQ ID NO:316, SEQ ID NO:318, and SEQ ID NO:320. In some embodiments, the engineered variant comprises an amino acid sequence of SEQ ID NO:314. In some embodiments, the engineered variant comprises an amino acid sequence of SEQ ID NO:316. In some embodiments, the engineered variant comprises an amino acid sequence of SEQ ID NO:318. In some embodiments, the engineered variant comprises an amino acid sequence of SEQ ID NO:320. Such engineered variants may produce CBDA from CBGA in a greater amount, as measured in mg/L or mM, than an amount of CBDA produced from CBGA by a cannabidiolic acid synthase polypeptide having an amino acid sequence of SEQ ID NO:3 under similar conditions for the same length of time and/or may produce CBDA from CBGA in an increased ratio of CBDA over THCA compared to that produced by a cannabidiolic acid synthase polypeptide having an amino acid sequence of SEQ ID NO:3 under similar conditions for the same length of time. In some embodiments, such engineered variants may produce CBDA from CBGA in an increased ratio of CBCA over CBDA compared to that produced by a cannabidiolic acid synthase polypeptide having an amino acid sequence of SEQ ID NO:3 under similar conditions for the same length of time.

The disclosure provides for an engineered variant, wherein the engineered variant comprises at least one immutable amino acid. The disclosure provides for an engineered variant, wherein the engineered variant comprises at least one immutable amino acid in a flavin adenine dinucleotide (FAD) binding domain, a berberine bridge enzyme (BBE) domain, or a combination of the foregoing.

In some embodiments, the engineered variant comprises at least one immutable amino acid in the FAD binding domain. In certain such embodiments, the engineered variant comprises at least 1, at least 2, at least 3, at least 4, at least 5, at least 6, at least 7, at least 8, at least 9, at least 10, at least 11, at least 12, at least 13, at least 14, or at least 15 immutable amino acids in the FAD binding domain. In some embodiments, wherein the engineered variant comprises at least one immutable amino acid in the FAD binding domain, the at least one immutable amino acid is selected from the group consisting of X87, X93, X99, X108, X110, X112, X117, X118, X120, X126, X127, X131, X141, X148, X152, X153, X155, X156, X157, X159, X160, X163, X173, X174, X176, X177, X178, X179, X182, X183, X184, X185, X187, X188, X189, X190, X191, X192, X193, X195, X201, X202, X205, X206, X210, X214, X223, X225, X226, X227, X228, X231, X234, X237, X238, X239, X245, X246, X248, and X251. In some embodiments, wherein the engineered variant comprises at least one immutable amino acid in the FAD binding domain, the at least one immutable amino acid is selected from the group consisting of P87, I93, C99, R108, R110, G112, E117, G118, 5120, P126, F127, D131, D141, W148, G152, A153, L155, G156, E157, Y159, Y160, N163, A173, G174, C176, P177, T178, V179, G182, G183, H184, F185, G187, G188, G189, Y190, G191, P192, L193, R195, A201, D202, I205, D206, V210, G214, G223, D225, L226, F227, W228, R231, G234, 5237, F238, G239, K245, I246, L248, and V251.

Engineered variants comprising a substitution at amino acid D115, such as D115N (SEQ ID NO:306), present in the FAD binding domain, may produce THCA from CBGA in an increased ratio of THCA over CBDA compared to that produced by a cannabidiolic acid synthase polypeptide having an amino acid sequence of SEQ ID NO:3 under similar conditions for the same length of time.

In some embodiments, the engineered variant comprises at least one immutable amino acid in the BBE domain. In certain such embodiments, the engineered variant comprises at least 1, at least 2, at least 3, at least 4, at least 5, at least 6, at least 7, at least 8, at least 9, at least 10, at least 11, at least 12, at least 13, at least 14, or at least 15 immutable amino acids in the BBE domain. In some embodiments, wherein the engineered variant comprises at least one immutable amino acid in the BBE domain, the at least one immutable amino acid selected from the group consisting of X484, X498, X502, X513, X514, X521, X528, X529, X533, X534, and X535. In some embodiments, wherein the engineered variant comprises at least one immutable amino acid in the BBE domain, the at least one immutable amino acid selected from the group consisting of R484, N498, A502, N513, F514, K521, N528, F529, E533, Q534, and S535.

The disclosure provides for an engineered variant, wherein the engineered variant comprises at least one immutable amino acid selected from the group consisting of X28, X34, X35, X37, X64, X70, X87, X93, X99, X108, X110, X112, X117, X118, X120, X126, X127, X131, X141, X148, X152, X153, X155, X156, X157, X159, X160, X163, X173, X174, X176, X177, X178, X179, X182, X183, X184, X185, X187, X188, X189, X190, X191, X192, X193, X195, X201, X202, X205, X206, X210, X214, X223, X225, X226, X227, X228, X231, X234, X237, X238, X239, X245, X246, X248, X251, X259, X276, X312, X313, X323, X341, X352, X354, X380, X381, X382, X383, X385, X386, X391, X419, X422, X425, X430, X431, X433, X434, X435, X437, X440, X443, X444, X464, X465, X468, X469, X471, X472, X476, X484, X498, X502, X513, X514, X521, X528, X529, X533, X534, and X535. In certain such embodiments, the engineered variant comprises at least one immutable amino acid selected from the group consisting of X37, X70, X93, X99, X117, X120, X127, X131, X156, X157, X159, X174, X176, X182, X183, X185, X187, X188, X189, X190, X191, X192, X195, X202, X206, X214, X228, X234, X238, X248, X276, X313, X323, X354, X381, X383, X385, X419, X422, X435, X440, X443, X444, X471, X476, X513, X514, X528, and X534. The disclosure provides for an engineered variant, wherein the engineered variant comprises at least one immutable amino acid selected from the group consisting of A28, F34, L35, C37, L64, N70, P87, I93, C99, R108, R110, G112, E117, G118, 5120, P126, F127, D131, D141, W148, G152, A153, L155, G156, E157, Y159, Y160, N163, A173, G174, C176, P177, T178, V179, G182, G183, H184, F185, G187, G188, G189, Y190, G191, P192, L193, R195, A201, D202, I205, D206, V210, G214, G223, D225, L226, F227, W228, R231, G234, 5237, F238, G239, K245, I246, L248, V251, V259, Q276, F312, 5313, L323, C341, F352, 5354, F380, K381, I382, K383, D385, Y386, I391, G419, M422, I425, I430, P431, P433, H434, R435, G437, Y440, W443, Y444, I464, Y465, M468, T469, Y471, V472, P476, R484, N498, A502, N513, F514, K521, N528, F529, E533, Q534, and S535. In certain such embodiments, the engineered variant comprises at least one immutable amino acid selected from the group consisting of C37, N70, I93, C99, E117, 5120, F127, D131, G156, E157, Y159, G174, C176, G182, G183, F185, G187, G188, G189, Y190, G191, P192, R195, D202, D206, G214, W228, G234, F238, L248, Q276, 5313, L323, S354, K381, K383, D385, G419, M422, R435, Y440, W443, Y444, Y471, P476, N513, F514, N528, and Q534. The disclosure provides for an engineered variant, wherein the engineered variant comprises at least one immutable amino acid selected from the group consisting of A28, F34, L35, C37, L64, N70, P87, I93, C99, R108, R110, G112, E117, G118, 5120, P126, F127, D131, D141, W148, G152, A153, L155, G156, E157, Y159, Y160, N163, A173, G174, C176, P177, T178, V179, G182, G183, H184, F185, G187, G188, G189, Y190, G191, P192, L193, R195, A201, D202, I205, D206, V210, G214, G223, D225, L226, F227, W228, R231, G234, S237, F238, G239, K245, I246, L248, V251, V259, Q276, F312, 5313, L323, C341, F352, S354, F380, K381, I382, K383, D385, Y386, I391, M412, L415, G419, M422, I425, I430, P431, P433, H434, R435, G437, Y440, W443, Y444, I445, I464, Y465, M468, T469, Y471, V472, P476, R484, N498, A502, N513, F514, K521, N528, F529, E533, Q534, and S535.

The disclosure provides for an engineered variant, wherein the engineered variant comprises at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, or at least 25 immutable amino acids, provided that the engineered variant has at least one amino acid substitution compared to SEQ ID NO:3. Engineered variants with combinations of the immutable amino acids and substitutions described herein can be made and the resulting engineered variants screened for improved cannabidiolic acid synthase (CBDAS) properties. Engineered variants comprising combinations of all of the substitutions and immutable amino acids described herein are intended to be encompassed by this disclosure.

Engineered variants comprising a substitution at amino acid D115, such as D115N (SEQ ID NO:306), or A414, such as A414T (SEQ ID NO:308), A414V (SEQ ID NO:310), and A414M (SEQ ID NO:312), may produce THCA from CBGA in an increased ratio of THCA over CBDA compared to that produced by a cannabidiolic acid synthase polypeptide having an amino acid sequence of SEQ ID NO:3 under similar conditions for the same length of time.

The disclosure provides for an engineered variant, wherein the engineered variant comprises at least one amino acid substitution at the C-terminus. In certain such embodiments, a hydrophilic amino acid is replaced with a hydrophobic amino acid. In some embodiments, wherein the engineered variant comprises at least one amino acid substitution at the C-terminus, a hydrophobic amino acid is replaced with a hydrophilic amino acid. In some embodiments, the engineered variant comprises at least one amino acid substitution at an amino acid selected from the group consisting of X541, X542, X543, and X544. In some embodiments, the engineered variant comprises at least one amino acid substitution at an amino acid selected from the group consisting of R541, H542, R543, and H544. In some embodiments, the engineered variant comprises at least one amino acid substitution selected from the group consisting of R541E, R541V, H542V, R543A, R543E, H544E, and H544D. The disclosure provides for an engineered variant, wherein the engineered variant comprises an amino acid sequence selected from the group consisting of SEQ ID NO:222, SEQ ID NO:224, SEQ ID NO:226, SEQ ID NO:228, SEQ ID NO:230, SEQ ID NO:232, and SEQ ID NO:234. Such engineered variants may produce CBDA from CBGA in a greater amount, as measured in mg/L or mM, than an amount of CBDA produced from CBGA by a cannabidiolic acid synthase polypeptide having an amino acid sequence of SEQ ID NO:3 under similar conditions for the same length of time.

The disclosure provides for an engineered variant, wherein the engineered variant comprises a truncation at the N-terminus, at the C-terminus, or at both the N- and C-termini. In some embodiments, the engineered variant comprises a truncation at the N-terminus. In some embodiments, the engineered variant comprises a truncation at the C-terminus. In some embodiments, the engineered variant comprises a truncation at both the N- and C-termini. In some embodiments, the engineered variant lacks a native signal polypeptide (i.e., amino acids 1-28 of SEQ ID NO:3).

In some embodiments, the engineered variant comprises a truncation at the N-terminus, at the C-terminus, or at both the N- and C-termini, and comprises an amino acid sequence with at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to SEQ ID NO:3. In some embodiments, the engineered variant comprises a truncation at the N-terminus, at the C-terminus, or at both the N- and C-termini, and comprises an amino acid sequence with at least 75%, at least 76%, at least 77%, at least 78%, at least 79%, at least 80%, at least 81%, at least 82%, at least 83%, or at least 84% sequence identity to SEQ ID NO:3.

In some embodiments, the engineered variant comprises a truncation of at least 1, at least 2, at least 3, at least 4, at least 5, at least 6, at least 7, at least 8, at least 9, or at least 10 amino acids at the N-terminus. In some embodiments, the engineered variant comprises a truncation of at least 11, at least 12, at least 13, at least 14, at least 15, at least 16, at least 17, at least 18, at least 19, or at least 20 amino acids at the N-terminus. In some embodiments, the engineered variant comprises a truncation of at least 21, at least 22, at least 23, at least 24, at least 25, at least 26, at least 27, at least 28, at least 29, or at least 30 amino acids at the N-terminus. In some embodiments, the engineered variant comprises a truncation of 1, 2, 3, 4, 5, 6, 7, 8, 9, or 10 amino acids at the N-terminus (e.g., 1-10 amino acids at the N-terminus). In some embodiments, the engineered variant comprises a truncation of 11, 12, 13, 14, 15, 16, 17, 18, 19, or 20 amino acids at the N-terminus (e.g., 11-20 amino acids at the N-terminus). In some embodiments, the engineered variant comprises a truncation of 21, 22, 23, 24, 25, 26, 27, 28, 29, or 30 amino acids at the N-terminus (e.g., 21-30 amino acids at the N-terminus).

In some embodiments, the engineered variant comprises a truncation of at least 1, at least 2, at least 3, at least 4, at least 5, at least 6, at least 7, at least 8, at least 9, or at least 10 amino acids at the C-terminus. In some embodiments, the engineered variant comprises a truncation of at least 11, at least 12, at least 13, at least 14, at least 15, at least 16, at least 17, at least 18, at least 19, or at least 20 amino acids at the C-terminus. In some embodiments, the engineered variant comprises a truncation of at least 21, at least 22, at least 23, at least 24, at least 25, at least 26, at least 27, at least 28, at least 29, or at least 30 amino acids at the C-terminus. In some embodiments, the engineered variant comprises a truncation of 1, 2, 3, 4, 5, 6, 7, 8, 9, or 10 amino acids at the C-terminus (e.g., 1-10 amino acids at the C-terminus). In some embodiments, the engineered variant comprises a truncation of 11, 12, 13, 14, 15, 16, 17, 18, 19, or 20 amino acids at the C-terminus (e.g., 11-20 amino acids at the C-terminus). In some embodiments, the engineered variant comprises a truncation of 21, 22, 23, 24, 25, 26, 27, 28, 29, or 30 amino acids at the C-terminus (e.g., 21-30 amino acids at the C-terminus).

In some embodiments, a truncated engineered variant of the disclosure may comprise a signal polypeptide. In certain such embodiments, the truncated engineered variant lacks a native signal polypeptide. In some embodiments, the signal polypeptide is a secretory signal polypeptide. In some embodiments, the secretory signal polypeptide is a native secretory signal polypeptide. In some embodiments, the secretory signal polypeptide is a synthetic secretory signal polypeptide. In some embodiments, the secretory signal polypeptide is an endoplasmic reticulum retention signal polypeptide. In certain such embodiments, the endoplasmic reticulum retention signal polypeptide is a HDEL polypeptide or a KDEL polypeptide. In some embodiments, the secretory signal polypeptide is a mitochondrial targeting signal polypeptide. In some embodiments, the secretory signal polypeptide is a Golgi targeting signal polypeptide. In some embodiments, the secretory signal polypeptide is a vacuolar localization signal polypeptide. In certain such embodiments, the vacuolar localization signal polypeptide is a PEP4t polypeptide or a PRC1t polypeptide. In certain such embodiments, the vacuolar localization signal polypeptide is a PEP4t polypeptide. In some embodiments, the secretory signal polypeptide is a plasma membrane localization signal polypeptide. In some embodiments, the secretory signal polypeptide is a peroxisome targeting signal polypeptide. In some embodiments, the peroxisome targeting signal polypeptide is a PEX8 polypeptide. In some embodiments, the secretory signal polypeptide is a mating factor secretory signal polypeptide (e.g., a MF polypeptide or an evolved MF polypeptide (MFev)). In some embodiments, the signal polypeptide is linked to the N-terminus of the engineered variant.

In some embodiments, a truncated engineered variant of the disclosure may comprise a membrane anchor. A membrane anchor may be a sequence that inserts into a membrane in the cell and anchor an attached polypeptide there. A membrane anchor may be present in a membrane external to the cell (e.g., GPI polypeptides) or internal to the cell (e.g., tail anchors, ER anchoring). Examples of membrane anchors include, but are not limited to, glycosylphosphatidylinositol membrane anchors (GPI polypeptides, e.g., AGA1), CAAX box polypeptides (get prenylated, e.g., RAS1), or tail anchored polypeptides with a hydrophobic C-terminus (e.g., phosphatidylinositol 4,5-bisphosphate 5-phosphatase (INP54) has a hydrophobic tail anchor in ER membrane or synaptobrevin 2 (VAMP2) has a hydrophobic poly-I tail anchor in vesicle membranes).

The disclosure provides for an engineered variant, wherein the engineered variant comprises an addition and/or deletion of one or more amino acids.

Engineered variants of a CBDAS polypeptide can be made and screened for improved properties, such as, production of CBDA from CBGA in a greater amount, as measured in mg/L or mM, than an amount of CBDA produced from CBGA by a cannabidiolic acid synthase polypeptide having an amino acid sequence of SEQ ID NO:3 under similar conditions for the same length of time. Additionally, engineered variants of a CBDAS polypeptide can be made and screened for improved properties, such as, production of CBDA from CBGA in an increased ratio of CBDA over THCA compared to that produced by a cannabidiolic acid synthase polypeptide having an amino acid sequence of SEQ ID NO:3 under similar conditions for the same length of time. In some embodiments, engineered variants of the disclosure may produce CBDA from CBGA in an increased ratio of CBDA over CBCA compared to that produced by a cannabidiolic acid synthase polypeptide having an amino acid sequence of SEQ ID NO:3 under similar conditions for the same length of time. Similar conditions may refer to reaction conditions at the same temperature, pH, buffer, and/or fermentation conditions and in the same culture medium and/or reaction solvent.

In some embodiments of the disclosure, the engineered variant produces cannabidiolic acid (CBDA) from cannabigerolic acid (CBGA) in an amount, as measured in mg/L or mM, at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% greater than an amount of CBDA produced from CBGA by a cannabidiolic acid synthase polypeptide having an amino acid sequence of SEQ ID NO:3 under similar conditions for the same length of time.

In some embodiments of the disclosure, the engineered variant produces CBDA from CBGA in a ratio of CBDA over THCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

In some embodiments of the disclosure, the engineered variant produces CBDA from CBGA in a ratio of CBDA over CBCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

These improved properties may be assessed by the conversion of CBGA to CBDA, or alternatively the conversion of another starting material to a desired cannabinoid or cannabinoid derivative, in vitro with isolated and/or purified engineered variants of the disclosure or in vivo in the context of a modified host cell expressing the engineered variant. In some embodiments, the modified host cell expresses polypeptides involved in the MEV pathway and/or polypeptides involved in cannabinoid biosynthesis and/or comprises modifications to the secretory pathway. It is contemplated that engineered variants of the disclosure having various degrees of stability, solubility, activity, and/or expression level in one or more of the test conditions will find use in the present disclosure for the production of cannabinoids or cannabinoid derivatives in a diversity of host cells.

Additionally, engineered variants of a CBDAS polypeptide can be made and screened for improved properties, such as, production of cannabinoids or cannabinoid derivatives by modified host cells comprising one or more nucleic acids comprising a nucleotide sequence encoding the engineered variant in an amount, as measured in mg/L or mM, greater than an amount of the cannabinoid or the cannabinoid derivative produced by modified host cells comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time.

Additionally, engineered variants of a CBDAS polypeptide can be made and screened for improved properties, such as, modified host cells comprising one or more nucleic acids comprising a nucleotide sequence encoding the engineered variant have a faster growth rate and/or higher biomass yield compared to a growth rate and/or higher biomass yield of modified host cells comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. Additionally, engineered variants of a CBDAS polypeptide can be made and screened for improved properties, such as, modified host cells comprising one or more nucleic acids comprising a nucleotide sequence encoding the engineered variant produce CBDA from CBGA in an increased ratio of CBDA over THCA compared to that produced by modified host cells comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. Moreover, engineered variants of a CBDAS polypeptide can be made and screened for improved properties, such as, modified host cells comprising one or more nucleic acids comprising a nucleotide sequence encoding the engineered variant produce CBDA from CBGA in an increased ratio of CBDA over CBCA compared to that produced by modified host cells comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. Similar culture conditions may refer to host cells grown in the same culture medium at the same temperature, pH, and/or fermentation conditions.

Moreover, engineered variants of a CBDAS polypeptide can be made and screened for improved properties, such as, modified host cells comprising one or more nucleic acids comprising a nucleotide sequence encoding the engineered variant do not have significantly decreased growth or viability compared to modified host cells comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. Additionally, engineered variants of a CBDAS polypeptide can be made and screened for improved properties, such as, modified host cells comprising one or more nucleic acids comprising a nucleotide sequence encoding the engineered variant do not have significantly decreased growth or viability compared to an unmodified host cell.

Nucleic Acids Comprising Nucleotide Sequences Encoding Engineered Variants of the Cannabidiolic Acid Synthase (CBDAS) Polypeptide and Expression Vectors and Constructs The disclosure provides for nucleic acids comprising nucleotide sequences encoding engineered variants of the cannabidiolic acid synthase (CBDAS) polypeptide disclosed herein and expression vectors and constructs comprising said nucleic acids.

The disclosure provides nucleic acids comprising nucleotide sequences encoding engineered variants of the disclosure. Some embodiments of the disclosure relate to a nucleic acid comprising a nucleotide sequence encoding an engineered variant of the disclosure comprising an amino acid sequence set forth in SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, or SEQ ID NO:234. In some embodiments, the nucleotide sequence is codon-optimized.

The disclosure provides nucleic acids comprising nucleotide sequences encoding engineered variants of the disclosure. Some embodiments of the disclosure relate to a nucleic acid comprising a nucleotide sequence encoding an engineered variant of the disclosure comprising an amino acid sequence set forth in SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:300, SEQ ID NO:302, or SEQ ID NO:304. In some embodiments, the nucleotide sequence is codon-optimized.

Some embodiments of the disclosure relate to a nucleic acid comprising a nucleotide sequence encoding an engineered variant of the disclosure comprising an amino acid sequence set forth in SEQ ID NO:60, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:88, SEQ ID NO:90, SEQ ID NO:92, SEQ ID NO:96, SEQ ID NO:102, SEQ ID NO:106, SEQ ID NO:112, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, or SEQ ID NO:234. In some embodiments, the nucleotide sequence is codon-optimized.

Some embodiments of the disclosure relate to a nucleic acid comprising a nucleotide sequence encoding an engineered variant of the disclosure comprising an amino acid sequence set forth in SEQ ID NO:66, SEQ ID NO:70, SEQ ID NO:72, SEQ ID NO:80, SEQ ID NO:82, SEQ ID NO:130, SEQ ID NO:136, SEQ ID NO:142, SEQ ID NO:146, SEQ ID NO:150, SEQ ID NO:156, SEQ ID NO:158, SEQ ID NO:160, SEQ ID NO:168, SEQ ID NO:170, SEQ ID NO:172, SEQ ID NO:176, SEQ ID NO:182, SEQ ID NO:184, SEQ ID NO:186, SEQ ID NO:190, SEQ ID NO:192, SEQ ID NO:194, SEQ ID NO:196, SEQ ID NO:198, SEQ ID NO:206, SEQ ID NO:214, SEQ ID NO:216, SEQ ID NO:218, SEQ ID NO:230, or SEQ ID NO:232. In some embodiments, the nucleotide sequence is codon-optimized.

Some embodiments of the disclosure relate to a nucleic acid comprising a nucleotide sequence encoding an engineered variant of the disclosure comprising an amino acid sequence set forth in SEQ ID NO:60, SEQ ID NO:64, SEQ ID NO:66, SEQ ID NO:68, SEQ ID NO:70, SEQ ID NO:72, SEQ ID NO:80, SEQ ID NO:82, SEQ ID NO:102, SEQ ID NO:104, SEQ ID NO:106, SEQ ID NO:116, SEQ ID NO:118, SEQ ID NO:120, SEQ ID NO:122, SEQ ID NO:124, SEQ ID NO:130, SEQ ID NO:132, SEQ ID NO:134, SEQ ID NO:136, SEQ ID NO:138, SEQ ID NO:140, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:224, SEQ ID NO:226, SEQ ID NO:228, SEQ ID NO:230, SEQ ID NO:232, or SEQ ID NO:234. In some embodiments, the nucleotide sequence is codon-optimized.

Some embodiments of the disclosure relate to a nucleic acid comprising a nucleotide sequence encoding an engineered variant of the disclosure comprising an amino acid sequence set forth in SEQ ID NO:222, SEQ ID NO:224, SEQ ID NO:226, SEQ ID NO:228, SEQ ID NO:230, SEQ ID NO:232, or SEQ ID NO:234. In some embodiments, the nucleotide sequence is codon-optimized.

Some embodiments of the disclosure relate to a nucleic acid comprising a nucleotide sequence encoding an engineered variant of the disclosure comprising an amino acid sequence set forth in SEQ ID NO:60, SEQ ID NO:82, SEQ ID NO:92, SEQ ID NO:104, SEQ ID NO:156, SEQ ID NO:160, SEQ ID NO:162, SEQ ID NO:172, SEQ ID NO:174, SEQ ID NO:176, SEQ ID NO:184, SEQ ID NO:198, SEQ ID NO:202, or SEQ ID NO:230. In some embodiments, the nucleotide sequence is codon-optimized.

Some embodiments of the disclosure relate to a nucleic acid comprising a nucleotide sequence encoding an engineered variant of the disclosure comprising an amino acid sequence set forth in SEQ ID NO:82, SEQ ID NO:156, SEQ ID NO:160, SEQ ID NO:172, SEQ ID NO:176, SEQ ID NO:184, or SEQ ID NO:198. In some embodiments, the nucleotide sequence is codon-optimized.

Some embodiments of the disclosure relate to a nucleic acid comprising a nucleotide sequence encoding an engineered variant of the disclosure comprising an amino acid sequence set forth in SEQ ID NO:300, SEQ ID NO:302, or SEQ ID NO:304. Some embodiments of the disclosure relate to a nucleic acid comprising a nucleotide sequence encoding an engineered variant of the disclosure comprising an amino acid sequence set forth in SEQ ID NO:300. In some embodiments, the nucleotide sequence is codon-optimized.

Some embodiments of the disclosure relate to a nucleic acid comprising a nucleotide sequence encoding an engineered variant of the disclosure comprising an amino acid sequence set forth in SEQ ID NO:314, SEQ ID NO:316, SEQ ID NO:318, or SEQ ID NO:320. Some embodiments of the disclosure relate to a nucleic acid comprising a nucleotide sequence encoding an engineered variant of the disclosure comprising an amino acid sequence set forth in SEQ ID NO:314. Some embodiments of the disclosure relate to a nucleic acid comprising a nucleotide sequence encoding an engineered variant of the disclosure comprising an amino acid sequence set forth in SEQ ID NO:316. Some embodiments of the disclosure relate to a nucleic acid comprising a nucleotide sequence encoding an engineered variant of the disclosure comprising an amino acid sequence set forth in SEQ ID NO:318. Some embodiments of the disclosure relate to a nucleic acid comprising a nucleotide sequence encoding an engineered variant of the disclosure comprising an amino acid sequence set forth in SEQ ID NO:320. In some embodiments, the nucleotide sequence is codon-optimized.

The disclosure also provides a nucleic acid comprising a nucleotide sequence encoding an engineered variant, wherein the nucleotide sequence is that set forth in SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, or SEQ ID NO:233. In some embodiments, the nucleotide sequence is codon-optimized.

The disclosure provides a nucleic acid comprising a nucleotide sequence encoding an engineered variant, wherein the nucleotide sequence is that set forth in SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, or SEQ ID NO:233, or a codon degenerate sequence of any of the foregoing. In some embodiments, the nucleotide sequence is codon-optimized.

The disclosure also provides a nucleic acid comprising a nucleotide sequence encoding an engineered variant, wherein the nucleotide sequence is that set forth in SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:299, SEQ ID NO:301, or SEQ ID NO:303. In some embodiments, the nucleotide sequence is codon-optimized.

The disclosure provides a nucleic acid comprising a nucleotide sequence encoding an engineered variant, wherein the nucleotide sequence is that set forth in SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:299, SEQ ID NO:301, or SEQ ID NO:303, or a codon degenerate sequence of any of the foregoing. In some embodiments, the nucleotide sequence is codon-optimized.

The disclosure provides a nucleic acid comprising a nucleotide sequence encoding an engineered variant, wherein the nucleotide sequence is that set forth in SEQ ID NO:59, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:87, SEQ ID NO:89, SEQ ID NO:91, SEQ ID NO:95, SEQ ID NO:101, SEQ ID NO:105, SEQ ID NO:111, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, or SEQ ID NO:233. In some embodiments, the nucleotide sequence is codon-optimized.

The disclosure provides a nucleic acid comprising a nucleotide sequence encoding an engineered variant, wherein the nucleotide sequence is that set forth in SEQ ID NO:59, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:87, SEQ ID NO:89, SEQ ID NO:91, SEQ ID NO:95, SEQ ID NO:101, SEQ ID NO:105, SEQ ID NO:111, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, or SEQ ID NO:233, or a codon degenerate sequence of any of the foregoing. In some embodiments, the nucleotide sequence is codon-optimized.

The disclosure also provides a nucleic acid comprising a nucleotide sequence encoding an engineered variant, wherein the nucleotide sequence is that set forth in SEQ ID NO:221, SEQ ID NO:223, SEQ ID NO:225, SEQ ID NO:227, SEQ ID NO:229, SEQ ID NO:231, or SEQ ID NO:233. In some embodiments, the nucleotide sequence is codon-optimized.

The disclosure also provides a nucleic acid comprising a nucleotide sequence encoding an engineered variant, wherein the nucleotide sequence is that set forth in SEQ ID NO:221, SEQ ID NO:223, SEQ ID NO:225, SEQ ID NO:227, SEQ ID NO:229, SEQ ID NO:231, or SEQ ID NO:233, or a codon degenerate sequence of any of the foregoing. In some embodiments, the nucleotide sequence is codon-optimized.

The disclosure provides a nucleic acid comprising a nucleotide sequence encoding an engineered variant, wherein the nucleotide sequence is that set forth in SEQ ID NO:65, SEQ ID NO:69, SEQ ID NO:71, SEQ ID NO:79, SEQ ID NO:81, SEQ ID NO:129, SEQ ID NO:135, SEQ ID NO:141, SEQ ID NO:145, SEQ ID NO:149, SEQ ID NO:155, SEQ ID NO:157, SEQ ID NO:159, SEQ ID NO:167, SEQ ID NO:169, SEQ ID NO:171, SEQ ID NO:175, SEQ ID NO:181, SEQ ID NO:183, SEQ ID NO:185, SEQ ID NO:189, SEQ ID NO:191, SEQ ID NO:193, SEQ ID NO:195, SEQ ID NO:197, SEQ ID NO:205, SEQ ID NO:213, SEQ ID NO:215, SEQ ID NO:217, SEQ ID NO:229, or SEQ ID NO:231. In some embodiments, the nucleotide sequence is codon-optimized.

The disclosure provides a nucleic acid comprising a nucleotide sequence encoding an engineered variant, wherein the nucleotide sequence is that set forth in SEQ ID NO:65, SEQ ID NO:69, SEQ ID NO:71, SEQ ID NO:79, SEQ ID NO:81, SEQ ID NO:129, SEQ ID NO:135, SEQ ID NO:141, SEQ ID NO:145, SEQ ID NO:149, SEQ ID NO:155, SEQ ID NO:157, SEQ ID NO:159, SEQ ID NO:167, SEQ ID NO:169, SEQ ID NO:171, SEQ ID NO:175, SEQ ID NO:181, SEQ ID NO:183, SEQ ID NO:185, SEQ ID NO:189, SEQ ID NO:191, SEQ ID NO:193, SEQ ID NO:195, SEQ ID NO:197, SEQ ID NO:205, SEQ ID NO:213, SEQ ID NO:215, SEQ ID NO:217, SEQ ID NO:229, or SEQ ID NO:231, or a codon degenerate sequence of any of the foregoing. In some embodiments, the nucleotide sequence is codon-optimized.

The disclosure provides a nucleic acid comprising a nucleotide sequence encoding an engineered variant, wherein the nucleotide sequence is that set forth in SEQ ID NO:59, SEQ ID NO:63, SEQ ID NO:65, SEQ ID NO:67, SEQ ID NO:69, SEQ ID NO:71, SEQ ID NO:79, SEQ ID NO:81, SEQ ID NO:101, SEQ ID NO:103, SEQ ID NO:105, SEQ ID NO:115, SEQ ID NO:117, SEQ ID NO:119, SEQ ID NO:121, SEQ ID NO:123, SEQ ID NO:129, SEQ ID NO:131, SEQ ID NO:133, SEQ ID NO:135, SEQ ID NO:137, SEQ ID NO:139, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:223, SEQ ID NO:225, SEQ ID NO:227, SEQ ID NO:229, SEQ ID NO:231, or SEQ ID NO:233. In some embodiments, the nucleotide sequence is codon-optimized.

The disclosure provides a nucleic acid comprising a nucleotide sequence encoding an engineered variant, wherein the nucleotide sequence is that set forth in SEQ ID NO:59, SEQ ID NO:63, SEQ ID NO:65, SEQ ID NO:67, SEQ ID NO:69, SEQ ID NO:71, SEQ ID NO:79, SEQ ID NO:81, SEQ ID NO:101, SEQ ID NO:103, SEQ ID NO:105, SEQ ID NO:115, SEQ ID NO:117, SEQ ID NO:119, SEQ ID NO:121, SEQ ID NO:123, SEQ ID NO:129, SEQ ID NO:131, SEQ ID NO:133, SEQ ID NO:135, SEQ ID NO:137, SEQ ID NO:139, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:223, SEQ ID NO:225, SEQ ID NO:227, SEQ ID NO:229, SEQ ID NO:231, or SEQ ID NO:233, or a codon degenerate sequence of any of the foregoing. In some embodiments, the nucleotide sequence is codon-optimized.

The disclosure provides a nucleic acid comprising a nucleotide sequence encoding an engineered variant, wherein the nucleotide sequence is that set forth in SEQ ID NO:59, SEQ ID NO:81, SEQ ID NO:91, SEQ ID NO:103, SEQ ID NO:155, SEQ ID NO:159, SEQ ID NO:161, SEQ ID NO:171, SEQ ID NO:173, SEQ ID NO:175, SEQ ID NO:183, SEQ ID NO:197, SEQ ID NO:201, or SEQ ID NO:229. In some embodiments, the nucleotide sequence is codon-optimized.

The disclosure provides a nucleic acid comprising a nucleotide sequence encoding an engineered variant, wherein the nucleotide sequence is that set forth in SEQ ID NO:59, SEQ ID NO:81, SEQ ID NO:91, SEQ ID NO:103, SEQ ID NO:155, SEQ ID NO:159, SEQ ID NO:161, SEQ ID NO:171, SEQ ID NO:173, SEQ ID NO:175, SEQ ID NO:183, SEQ ID NO:197, SEQ ID NO:201, or SEQ ID NO:229, or a codon degenerate sequence of any of the foregoing. In some embodiments, the nucleotide sequence is codon-optimized.

The disclosure provides a nucleic acid comprising a nucleotide sequence encoding an engineered variant, wherein the nucleotide sequence is that set forth in SEQ ID NO:81, SEQ ID NO:155, SEQ ID NO:159, SEQ ID NO:171, SEQ ID NO:175, SEQ ID NO:183, or SEQ ID NO:197. In some embodiments, the nucleotide sequence is codon-optimized.

The disclosure provides a nucleic acid comprising a nucleotide sequence encoding an engineered variant, wherein the nucleotide sequence is that set forth in SEQ ID NO:81, SEQ ID NO:155, SEQ ID NO:159, SEQ ID NO:171, SEQ ID NO:175, SEQ ID NO:183, or SEQ ID NO:197, or a codon degenerate sequence of any of the foregoing. In some embodiments, the nucleotide sequence is codon-optimized.

The disclosure provides a nucleic acid comprising a nucleotide sequence encoding an engineered variant, wherein the nucleotide sequence is that set forth in SEQ ID NO:299, SEQ ID NO:301, or SEQ ID NO:303. In some embodiments, the nucleotide sequence is codon-optimized.

The disclosure provides a nucleic acid comprising a nucleotide sequence encoding an engineered variant, wherein the nucleotide sequence is that set forth in SEQ ID NO:299, SEQ ID NO:301, or SEQ ID NO:303, or a codon degenerate sequence of any of the foregoing. In some embodiments, the nucleotide sequence is codon-optimized.

The disclosure provides a nucleic acid comprising a nucleotide sequence encoding an engineered variant, wherein the nucleotide sequence is that set forth in SEQ ID NO:299. In some embodiments, the nucleotide sequence is codon-optimized.

The disclosure provides a nucleic acid comprising a nucleotide sequence encoding an engineered variant, wherein the nucleotide sequence is that set forth in SEQ ID NO:299, or a codon degenerate sequence of any of the foregoing. In some embodiments, the nucleotide sequence is codon-optimized.

The disclosure provides a nucleic acid comprising a nucleotide sequence encoding an engineered variant, wherein the nucleotide sequence is that set forth in SEQ ID NO:313, SEQ ID NO:315, SEQ ID NO:317, or SEQ ID NO:319. In some embodiments, the nucleotide sequence is codon-optimized.

The disclosure provides a nucleic acid comprising a nucleotide sequence encoding an engineered variant, wherein the nucleotide sequence is that set forth in SEQ ID NO:313, SEQ ID NO:315, SEQ ID NO:317, or SEQ ID NO:319, or a codon degenerate sequence of any of the foregoing. In some embodiments, the nucleotide sequence is codon-optimized.

The disclosure provides a nucleic acid comprising a nucleotide sequence encoding an engineered variant, wherein the nucleotide sequence is that set forth in SEQ ID NO:313. In some embodiments, the nucleotide sequence is codon-optimized.

The disclosure provides a nucleic acid comprising a nucleotide sequence encoding an engineered variant, wherein the nucleotide sequence is that set forth in SEQ ID NO:313, or a codon degenerate sequence of any of the foregoing. In some embodiments, the nucleotide sequence is codon-optimized.

The disclosure provides a nucleic acid comprising a nucleotide sequence encoding an engineered variant, wherein the nucleotide sequence is that set forth in SEQ ID NO:315. In some embodiments, the nucleotide sequence is codon-optimized.

The disclosure provides a nucleic acid comprising a nucleotide sequence encoding an engineered variant, wherein the nucleotide sequence is that set forth in SEQ ID NO:315, or a codon degenerate sequence of any of the foregoing. In some embodiments, the nucleotide sequence is codon-optimized.

The disclosure provides a nucleic acid comprising a nucleotide sequence encoding an engineered variant, wherein the nucleotide sequence is that set forth in SEQ ID NO:317. In some embodiments, the nucleotide sequence is codon-optimized.

The disclosure provides a nucleic acid comprising a nucleotide sequence encoding an engineered variant, wherein the nucleotide sequence is that set forth in SEQ ID NO:317, or a codon degenerate sequence of any of the foregoing. In some embodiments, the nucleotide sequence is codon-optimized.

The disclosure provides a nucleic acid comprising a nucleotide sequence encoding an engineered variant, wherein the nucleotide sequence is that set forth in SEQ ID NO:319. In some embodiments, the nucleotide sequence is codon-optimized.

The disclosure provides a nucleic acid comprising a nucleotide sequence encoding an engineered variant, wherein the nucleotide sequence is that set forth in SEQ ID NO:319, or a codon degenerate sequence of any of the foregoing. In some embodiments, the nucleotide sequence is codon-optimized.

Further included are nucleic acids that hybridize to the nucleic acids disclosed herein. Hybridization conditions may be stringent in that hybridization will occur if there is at least a 90%, at least a 95%, or at least a 97% sequence identity with the nucleotide sequence present in the nucleic acid encoding the polypeptides disclosed herein. The stringent conditions may include those used for known Southern hybridizations such as, for example, incubation overnight at 42° C. in a solution having 50% formamide, 5×SSC (150 mM NaCl, 15 mM trisodium citrate), 50 mM sodium phosphate (pH 7.6), 5×Denhardt's solution, 10% dextran sulfate, and 20 micrograms/milliliter denatured, sheared salmon sperm DNA, following by washing the hybridization support in 0.1×SSC at about 65° C. Other known hybridization conditions are well known and are described in Sambrook et al., Molecular Cloning: A Laboratory Manual, Third Edition, Cold Spring Harbor, N.Y. (2001).

The length of the nucleic acids disclosed herein may depend on the intended use. For example, if the intended use is as a primer or probe, for example for PCR amplification or for screening a library, the length of the nucleic acid will be less than the full length sequence, for example, 15-50 nucleotides. In certain such embodiments, the primers or probes may be substantially identical to a highly conserved region of the nucleotide sequence or may be substantially identical to either the 5' or 3' end of the nucleotide sequence. In some cases, these primers or probes may use universal bases in some positions so as to be "substantially identical" but still provide flexibility in sequence recognition. It is of note that suitable primer and probe hybridization conditions are well known in the art.

Some embodiments of the disclosure relate to a vector comprising one or more nucleic acids disclosed herein. Some embodiments of the disclosure relate to an expression construct comprising one or more nucleic acids disclosed herein. Some embodiments of the disclosure relate to nucleic acids comprising codon-optimized nucleotide sequences encoding the engineered variants of the disclosure. In some embodiments, the nucleic acids disclosed herein are heterologous.

Methods of Screening Engineered Variants of the Cannabidiolic Acid Synthase (CBDAS) Polypeptide The disclosure provides a method of screening an engineered variant of a cannabidiolic acid synthase (CBDAS) polypeptide comprising an amino acid sequence of SEQ ID NO:3 with one or more amino acid substitutions. In certain such embodiments, the method involves a competition assay wherein the engineered variant of the disclosure is expressed in a modified host cells alongside a related enzyme.

Some embodiments of the disclosure relate to a method of screening an engineered variant of a cannabidiolic acid synthase (CBDAS) polypeptide comprising an amino acid sequence of SEQ ID NO:3 with one or more amino acid substitutions, the method comprising:

a) dividing a population of host cells into a control population and a test population;
b) co-expressing in the control population a CBDAS polypeptide having an amino acid sequence of SEQ ID NO:3 and a comparison cannabinoid synthase polypeptide, wherein the CBDAS polypeptide having an amino acid sequence of SEQ ID NO:3 can convert CBGA to a first cannabinoid, CBDA, and the comparison cannabinoid synthase polypeptide can convert the same CBGA to a different second cannabinoid;
c) co-expressing in the test population the engineered variant and the comparison cannabinoid synthase polypeptide, wherein the engineered variant may convert CBGA to the same first cannabinoid, CBDA, as the CBDAS polypeptide having an amino acid sequence of SEQ ID NO:3, and wherein the comparison cannabinoid synthase polypeptide can convert the same CBGA to the second cannabinoid and is expressed at similar levels in the test population and in the control population;
d) measuring a ratio of the first cannabinoid, CBDA, over the second cannabinoid produced by both the test population and the control population; and
e) measuring an amount, in mg/L or mM, of the first cannabinoid produced by both the test population and the control population. In certain such embodiments, the engineered variant is an engineered variant of the disclosure.

In some embodiments, the test population is identified as comprising an engineered variant having improved in vivo performance compared to the cannabidiolic acid synthase polypeptide having an amino acid sequence of SEQ ID NO:3 by producing the first cannabinoid in a greater amount, as measured in mg/L or mM, by the test population compared to the amount produced by the control population under similar culture conditions for the same length of time. In some embodiments, the test population is identified as comprising an engineered variant having improved in vivo performance compared to the cannabidiolic acid synthase polypeptide having an amino acid sequence of SEQ ID NO:3, wherein improved in vivo performance is demonstrated by an increase in the ratio of the first cannabinoid over the second cannabinoid produced by the test population compared to that produced by the control population under similar culture conditions for the same length of time.

In some embodiments, the cannabinoid synthase polypeptide is a tetrahydrocannabinolic acid synthase (THCAS) polypeptide. In certain such embodiments, the THCAS polypeptide comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:44. In some embodiments, a nucleotide sequence encoding the THCAS polypeptide is the nucleotide sequence set forth in SEQ ID NO:45. In some embodiments, a nucleotide sequence encoding the THCAS polypeptide is the nucleotide sequence set forth in SEQ ID NO:45, or a codon degenerate nucleotide sequence thereof. In some embodiments, a nucleotide sequence encoding the THCAS polypeptide has at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:45. In some embodiments, the second cannabinoid is THCA.

Modified Host Cells for Expressing Engineered Variants of the Cannabidiolic Acid Synthase (CBDAS) Polypeptide and for Producing Cannabinoids and Cannabinoid Derivatives The present disclosure provides modified host cells comprising one or more nucleic acids comprising a nucleotide sequence encoding an engineered variant of the disclosure. In certain such embodiments, the modified host cells of the disclosure are for expressing an engineered variant and/or for producing a cannabinoid or a cannabinoid derivative. In some embodiments, the nucleotide sequence encoding the engineered variant is codon-optimized.

The disclosure also provides nucleic acids (e.g., heterologous nucleic acids), which can be introduced into microorganisms (e.g., modified host cells), resulting in expression or overexpression of the engineered variants of the disclosure, which can then be utilized in vitro (e.g., cell-free) or in vivo for the production of cannabinoids or cannabinoid derivatives. In some embodiments, these nucleic acids comprise a codon-optimized nucleotide sequence encoding the engineered variant.

Cannabinoid synthase polypeptides, secreted polypeptides, such as the engineered variants of the disclosure, have structural features that may hinder expression in modified host cells, such as modified yeast cells. Cannabinoid synthase polypeptides, including the engineered variants of the disclosure, comprise disulfide bonds, numerous glycosylation sites, including N-glycosylation sites, and a bicovalently attached flavin adenine dinucleotide (FAD) cofactor moiety. Often these secreted polypeptides are misfolded or mislocalized, resulting in low expression, polypeptides lacking activity, reduced host cell viability, and/or cell death. As disclosed herein, manipulation of secretory pathway in host cells modified with one or more nucleic acids comprising a nucleotide sequence encoding an engineered variant of the disclosure may improve expression, folding, and enzymatic activity of the engineered variant of the disclosure as well as viability of the modified host cell. In certain such embodiments, the nucleotide sequence encoding the engineered variant is codon-optimized.

To produce cannabinoids or cannabinoid derivatives and create biosynthetic pathways within modified host cells, modified host cells comprising one or more nucleic acids comprising a nucleotide sequence encoding an engineered variant of the disclosure may express or overexpress combinations of heterologous nucleic acids comprising nucleotide sequences encoding polypeptides involved in cannabinoid or cannabinoid precursor (e.g., geranylpyrophosphate (GPP), prenyl phosphates, olivetolic acid, or hexanoyl-CoA) biosynthesis. In some embodiments, the nucleotide sequences encoding the polypeptides involved in cannabinoid or cannabinoid precursor (e.g., geranylpyrophosphate (GPP), prenyl phosphates, olivetolic acid, or hexanoyl-CoA) biosynthesis are codon-optimized. In some embodiments, the modified host cells of the disclosure for producing cannabinoid or cannabinoid derivatives comprising one or more nucleic acids comprising a nucleotide sequence encoding an engineered variant of the disclosure comprise one or more modifications to modulate the expression of one or more secretory pathway polypeptides. The one or more modifications to modulate the expression of one or more secretory pathway polypeptides may include introducing into a host cell one or more heterologous nucleic acids comprising nucleotide sequences encoding one or more secretory pathway polypeptides and/or deletion or downregulation of one or more genes encoding one or more secretory pathway polypeptides in a host cell. In some embodiments, a modified host cell of the present disclosure for producing cannabinoids or cannabinoid derivatives comprising one or more nucleic acids comprising a nucleotide sequence encoding an engineered variant of the disclosure comprises one or more heterologous nucleic acids comprising nucleotide sequences encoding one or more secretory pathway polypeptides, resulting in expression or overexpression of the one or more secretory pathway polypeptides. In some embodiments, the nucleotide sequences encoding the one or more secretory pathway polypeptides are codon-optimized. In some embodiments, the modified host cell for producing cannabinoids or cannabinoid derivatives comprising one or more nucleic acids comprising a nucleotide sequence encoding an engineered variant of the disclosure comprises a deletion or downregulation of one or more genes encoding one or more secretory pathway polypeptides, reducing or eliminating the expression of the one or more secretory pathway polypeptides. In certain such embodiments, the modified host cells comprise a deletion of one or more genes encoding one or more secretory pathway polypeptides. In some embodiments, the modified host cells comprise a downregulation of one or more genes encoding one or more secretory pathway polypeptides.

In some embodiments, culturing of a modified host cell for producing cannabinoids or cannabinoid derivatives in a culture medium provides for synthesis of the cannabinoid or the cannabinoid derivative.

To express an engineered variant of the disclosure, the modified host cells may express or overexpress one or more nucleic acids comprising a nucleotide sequence encoding the engineered variant. In some embodiments, the nucleotide sequences encoding the engineered variants are codon-optimized. In some embodiments, the modified host cells of the disclosure for expressing an engineered variant of the disclosure comprising one or more nucleic acids comprising a nucleotide sequence encoding the engineered variant comprise one or more modifications to modulate the expression of one or more secretory pathway polypeptides. The one or more modifications to modulate the expression of one or more secretory pathway polypeptides may include introducing into a host cell one or more heterologous nucleic acids comprising nucleotide sequences encoding one or more secretory pathway polypeptides and/or deletion or downregulation of one or more genes encoding one or more secretory pathway polypeptides in a host cell. In some embodiments, a modified host cell of the present disclosure for expressing an engineered variant of the disclosure comprising one or more nucleic acids comprising a nucleotide sequence encoding the engineered variant comprises one or more heterologous nucleic acids comprising nucleotide sequences encoding one or more secretory pathway polypeptides, resulting in expression or overexpression of the one or more secretory pathway polypeptides. In some embodiments, the nucleotide sequences encoding the one or more secretory pathway polypeptides are codon-optimized. In some embodiments, the modified host cell for expressing an engineered variant of the disclosure comprising one or more nucleic acids comprising a nucleotide sequence encoding the engineered variant comprises a deletion or downregulation of one or more genes encoding one or more secretory pathway polypeptides, reducing or eliminating the expression of the one or more secretory pathway polypeptides. In certain such embodiments, the modified host cells comprise a deletion of one or more genes encoding one or more secretory pathway polypeptides. In some embodiments, the modified host cells comprise a downregulation of one or more genes encoding one or more secretory pathway polypeptides. In some embodiments of the modified host cell for expressing an engineered variant of the disclosure, the modified host cell comprises one or more heterologous nucleic acids comprising nucleotide sequences encoding one or more polypeptides involved in cannabinoid or cannabinoid precursor biosynthesis. In some embodiments, the nucleotide sequences encoding the one or more polypeptides involved in cannabinoid or cannabinoid precursor biosynthesis are codon-optimized.

Secretory Pathway Modifications

Secretory pathway polypeptides with modulated expression in the modified host cells of the disclosure may include, but are not limited to: a KAR2 polypeptide, a ROT2 polypeptide, a PIM polypeptide, an ERO1 polypeptide, a FAD1 polypeptide, a PEP4 polypeptide, and an IRE1 polypeptide. Expression of secretory pathway polypeptides may be modulated by introducing into a host cell one or more heterologous nucleic acids comprising nucleotide sequences encoding one or more secretory pathway polypeptides and/or deletion or downregulation of one or more genes encoding one or more secretory pathway polypeptides in a host cell. In some embodiments, the nucleotide sequences encoding the one or more secretory pathway polypeptides are codon-optimized.

In some embodiments, the modified host cells of the disclosure comprise a deletion or downregulation of one or more of the following genes: a ROT2 gene or a PEP4 gene. In some embodiments, the modified host cells of the disclosure comprise a deletion of one or more of the following genes: a ROT2 gene or a PEP4 gene. In some embodiments, the modified host cells of the disclosure comprise a downregulation of one or more of the following genes: a ROT2 gene or a PEP4 gene.

The secretory pathway polypeptides and the nucleotide sequences encoding the secretory pathway polypeptides may be derived from any suitable source, for example, bacteria, yeast, fungi, algae, human, plant, or mouse. In some embodiments, the secretory pathway polypeptides and the nucleotide sequences encoding the secretory pathway polypeptides may be derived from *Pichia pastoris* (now known as *Komagataella phaffii*), *Pichia finlandica, Pichia trehalophila, Pichia koclamae, Pichia membranaefaciens, Pichia opuntiae, Pichia thermotolerans, Pichia salictaria, Pichia guercuum, Pichia pijperi, Pichia stiptis, Pichia methanolica, Pichia* sp., *Saccharomyces cerevisiae, Saccharomyces* sp., *Hansenula polymorpha* (now known as *Pichia angusta*), *Yarrowia lipolytica, Kluyveromyces* sp., *Kluyveromyces lactis, Kluyveromyces marxianus, Schizosaccharomyces pombe, Scheffersomyces stipites, Dekkera bruxellensis, Blastobotrys adeninivorans* (formerly *Arxula adeninivorans*), *Candida albicans, Aspergillus nidulans, Aspergillus niger, Aspergillus oryzae, Trichoderma reesei, Chrysosporium lucknowense, Fusarium* sp., *Fusarium gramineum, Fusarium venenatum, Neurospora crassa*, and the like. In some embodiments, the disclosure also encompasses orthologous genes encoding the secretory pathway polypeptides disclosed herein. Exemplary secretory pathway polypeptides disclosed herein may also include a full-length secretory pathway polypeptide, a fragment of a secretory pathway polypeptide, a variant of a secretory pathway polypeptide, a truncated secretory pathway polypeptide, or a fusion polypeptide that has at least one activity of a secretory pathway polypeptide. The disclosure also provides for nucleotide sequences encoding secretory pathway polypeptides, such as, a full-length secretory pathway polypeptide, a fragment of a secretory pathway polypeptide, a variant of a secretory pathway polypeptide, a truncated secretory pathway polypeptide, or a fusion polypeptide that has at least one activity of a secretory pathway polypeptide. In some embodiments, the nucleotide sequences encoding the secretory pathway polypeptides are codon-optimized.

Exemplary KAR2 polypeptides disclosed herein may include a full-length KAR2 polypeptide, a fragment of a KAR2 polypeptide, a variant of a KAR2 polypeptide, a truncated KAR2 polypeptide, or a fusion polypeptide that has at least one activity of a KAR2 polypeptide.

Exemplary ROT2 polypeptides disclosed herein may include a full-length ROT2 polypeptide, a fragment of a ROT2 polypeptide, a variant of a ROT2 polypeptide, a truncated ROT2 polypeptide, or a fusion polypeptide that has at least one activity of a ROT2 polypeptide.

Exemplary PDI1 polypeptides disclosed herein may include a full-length PDI1 polypeptide, a fragment of a PDI1 polypeptide, a variant of a PDI1 polypeptide, a truncated PDI1 polypeptide, or a fusion polypeptide that has at least one activity of a PDI1 polypeptide.

Exemplary ERO1 polypeptides disclosed herein may include a full-length ERO1 polypeptide, a fragment of an ERO1 polypeptide, a variant of an ERO1 polypeptide, a truncated ERO1 polypeptide, or a fusion polypeptide that has at least one activity of an ERO1 polypeptide.

Exemplary FAD1 polypeptides disclosed herein may include a full-length FAD1 polypeptide, a fragment of a FAD1 polypeptide, a variant of a FAD1 polypeptide, a truncated FAD1 polypeptide, or a fusion polypeptide that has at least one activity of a FAD1 polypeptide.

Exemplary PEP4 polypeptides disclosed herein may include a full-length PEP4 polypeptide, a fragment of a PEP4 polypeptide, a variant of a PEP4 polypeptide, a truncated PEP1 polypeptide, or a fusion polypeptide that has at least one activity of a PEP4 polypeptide.

Exemplary IRE1 polypeptides disclosed herein may include a full-length IRE1 polypeptide, a fragment of an IRE1 polypeptide (e.g., missing the first 7 amino acids), a variant of an IRE1 polypeptide, a truncated IRE1 polypeptide, or a fusion polypeptide that has at least one activity of an IRE1 polypeptide.

Modified host cells of the disclosure may comprise one or more modifications to modulate the expression of one or more of a KAR2 polypeptide, a ROT2 polypeptide, a PDI1 polypeptide, an ERO1 polypeptide, a FAD1 polypeptide, a PEP4 polypeptide, or an IRE1 polypeptide. The one or more modifications to modulate the expression of one or more of a KAR2 polypeptide, a ROT2 polypeptide, a PDI1 polypeptide, an ERO1 polypeptide, a FAD1 polypeptide, a PEP4 polypeptide, or an IRE1 polypeptide may include introducing into a host cell one or more heterologous nucleic acids comprising nucleotide sequences encoding one or more of the KAR2 polypeptide, the PDI1 polypeptide, the ERO1 polypeptide, the FAD1 polypeptide, or the IRE1 polypeptide and/or deletion or downregulation of one or more genes encoding one or more of the ROT2 polypeptide or the PEP4 polypeptide in a host cell. In some embodiments, a modified host cell of the present disclosure comprises one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide resulting in expression or overexpression of the KAR2 polypeptide, the PDI1 polypeptide, the ERO1 polypeptide, the FAD1 polypeptide, or the IRE1 polypeptide. In some embodiments, the modified host cells of the disclosure comprise a deletion or downregulation of one or more genes encoding one or more of a ROT2 polypeptide or a PEP4 polypeptide, reducing or eliminating the expression of the ROT2 polypeptide or the PEP4 polypeptide.

In some embodiments, the one or more modifications to modulate the expression of one or more secretory pathway polypeptides may improve modified host cell viability. Improving modified host cell viability may improve the industrial fermentation process. The ERO1 polypeptide may serve as a partner to the PDI1 polypeptide, a protein disulfide isomerase polypeptide. Modulating the expression of an IRE1 polypeptide may prevent degradation of expressed engineered variants of the disclosure.

In some embodiments, the modified host cells of the disclosure comprise one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide.

In some embodiments, the modified host cells of the disclosure comprise one or more heterologous nucleic acids comprising nucleotide sequences encoding one or more secretory pathway polypeptides comprising the amino acid sequences set forth in SEQ ID NO:5 (a KAR2 polypeptide), SEQ ID NO:9 (a PDI1 polypeptide), SEQ ID NO:7 (an ERO1 polypeptide), SEQ ID NO:298 (a FAD1 polypeptide), SEQ ID NO:11 (an IRE1 polypeptide), or SEQ ID NO:296 (an IRE1 polypeptide fragment).

In some embodiments, the modified host cells of the disclosure comprise one or more heterologous nucleic acids comprising nucleotide sequences encoding one or more secretory pathway polypeptides comprising the amino acid sequences set forth in SEQ ID NO:5 (a KAR2 polypeptide), SEQ ID NO:9 (a PDI1 polypeptide), SEQ ID NO:7 (an ERO1 polypeptide), SEQ ID NO:298 (a FAD1 polypeptide), SEQ ID NO:11 (an IRE1 polypeptide), or SEQ ID NO:296 (an IRE1 polypeptide fragment), or a conservatively substituted amino acid sequence of any of the foregoing.

In some embodiments, the modified host cells of the disclosure comprise one or more heterologous nucleic acids comprising nucleotide sequences encoding one or more secretory pathway polypeptides comprising amino acid sequences having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:5 (a KAR2 polypeptide), SEQ ID NO:9 (a PDI1 polypeptide), SEQ ID NO:7 (an ERO1 polypeptide), SEQ ID NO:298 (a FAD1 polypeptide), SEQ ID NO:11 (an IRE1 polypeptide), or SEQ ID NO:296 (an IRE1 polypeptide fragment).

In some embodiments, the modified host cells of the disclosure comprise a deletion or downregulation of one or more genes encoding one or more of a ROT2 polypeptide or a PEP4 polypeptide.

In some embodiments, the modified host cells of the disclosure comprise a deletion or downregulation of one or more genes encoding one or more secretory pathway polypeptides comprising the amino acid sequences set forth in SEQ ID NO:13 (a ROT2 polypeptide) or SEQ ID NO:15 (a PEP4 polypeptide).

In some embodiments, a modified host cell of the present disclosure comprises one or more heterologous nucleic acids comprising nucleotide sequences encoding one or more of a KAR2 polypeptide, a PDI1 polypeptide, an ERO1 polypeptide, or an IRE1 polypeptide. In some embodiments, a modified host cell of the present disclosure comprises one or more heterologous nucleic acids comprising nucleotide sequences encoding two or more of a KAR2 polypeptide, a PDI1 polypeptide, an ERO1 polypeptide, or an IRE1 polypeptide. In some embodiments, a modified host cell of the present disclosure comprises one or more heterologous nucleic acids comprising nucleotide sequences encoding three or more of a KAR2 polypeptide, a PDI1 polypeptide, an ERO1 polypeptide, or an IRE1 polypeptide. In some embodiments, a modified host cell of the present disclosure comprises one or more heterologous nucleic acids comprising a nucleotide sequence encoding a KAR2 polypeptide, one or more heterologous nucleic acids comprising a nucleotide sequence encoding a PDI1 polypeptide, one or more heterologous nucleic acids comprising a nucleotide sequence encoding an ERO1 polypeptide, and one or more heterologous nucleic acids comprising a nucleotide sequence encoding an IRE1 polypeptide.

In some embodiments, a modified host cell of the present disclosure comprises one or more heterologous nucleic acids comprising nucleotide sequences encoding one or more of a KAR2 polypeptide, a PDI1 polypeptide, an ERO1 polypeptide, or a FAD1 polypeptide. In some embodiments, a modified host cell of the present disclosure comprises one or more heterologous nucleic acids comprising nucleotide sequences encoding two or more of a KAR2 polypeptide, a PDI1 polypeptide, an ERO1 polypeptide, or a FAD1 polypeptide. In some embodiments, a modified host cell of the present disclosure comprises one or more heterologous nucleic acids comprising nucleotide sequences encoding three or more of a KAR2 polypeptide, a PDI1 polypeptide, an ERO1 polypeptide, or a FAD1 polypeptide. In some embodiments, a modified host cell of the present disclosure comprises one or more heterologous nucleic acids comprising a nucleotide sequence encoding a KAR2 polypeptide, one or more heterologous nucleic acids comprising a nucleotide sequence encoding a PDI1 polypeptide, one or more heterologous nucleic acids comprising a nucleotide sequence encoding an ERO1 polypeptide, and one or more heterologous nucleic acids comprising a nucleotide sequence encoding a FAD1 polypeptide.

In some embodiments, the nucleotide sequences encoding the one or more of a KAR2 polypeptide, a PDI1 polypeptide, an ERO1 polypeptide, a FAD1 polypeptide, or an IRE1 polypeptide are codon-optimized.

In some embodiments, the modified host cells of the disclosure comprise a deletion or downregulation of one or more genes encoding one or more of a ROT2 polypeptide or a PEP4 polypeptide. In some embodiments, the modified host cells of the disclosure comprise a deletion or downregulation of genes encoding a ROT2 polypeptide and a PEP4 polypeptide.

Exemplary heterologous nucleic acids disclosed herein may include nucleic acids comprising a nucleotide sequence that encodes a secretory pathway polypeptide, such as, a full-length secretory pathway polypeptide, a fragment of a secretory pathway polypeptide, a variant of a secretory pathway polypeptide, a truncated secretory pathway polypeptide, or a fusion polypeptide that has at least one activity of a secretory pathway polypeptide. In some embodiments, the nucleotide sequence is codon-optimized.

Exemplary heterologous nucleic acids disclosed herein may include nucleic acids comprising a nucleotide sequence that encodes a KAR2 polypeptide, such as, a full-length KAR2 polypeptide, a fragment of a KAR2 polypeptide, a variant of a KAR2 polypeptide, a truncated KAR2 polypeptide, or a fusion polypeptide that has at least one activity of a KAR2 polypeptide. In some embodiments, the nucleotide sequence is codon-optimized.

Exemplary heterologous nucleic acids disclosed herein may include nucleic acids comprising a nucleotide sequence that encodes a ROT2 polypeptide, such as, a full-length ROT2 polypeptide, a fragment of a ROT2 polypeptide, a variant of a ROT2 polypeptide, a truncated ROT2 polypeptide, or a fusion polypeptide that has at least one activity of a ROT2 polypeptide. In some embodiments, the nucleotide sequence is codon-optimized.

Exemplary heterologous nucleic acids disclosed herein may include nucleic acids comprising a nucleotide sequence that encodes a PDI1 polypeptide, such as, a full-length PDI1 polypeptide, a fragment of a PDI1 polypeptide, a variant of a PDI1 polypeptide, a truncated PDI1 polypeptide, or a fusion polypeptide that has at least one activity of a PDI1 polypeptide. In some embodiments, the nucleotide sequence is codon-optimized.

Exemplary heterologous nucleic acids disclosed herein may include nucleic acids comprising a nucleotide sequence that encodes an ERO1 polypeptide, such as, a full-length ERO1 polypeptide, a fragment of an ERO1 polypeptide, a variant of an ERO1 polypeptide, a truncated ERO1 polypeptide, or a fusion polypeptide that has at least one activity of an ERO1 polypeptide. In some embodiments, the nucleotide sequence is codon-optimized.

Exemplary heterologous nucleic acids disclosed herein may include nucleic acids comprising a nucleotide sequence that encodes a FAD1 polypeptide, such as, a full-length FAD1 polypeptide, a fragment of a FAD1 polypeptide, a variant of a FAD1 polypeptide, a truncated FAD1 polypeptide, or a fusion polypeptide that has at least one activity of a FAD1 polypeptide. In some embodiments, the nucleotide sequence is codon-optimized.

Exemplary heterologous nucleic acids disclosed herein may include nucleic acids comprising a nucleotide sequence that encodes a PEP4 polypeptide, such as, a full-length PEP4 polypeptide, a fragment of a PEP4 polypeptide, a variant of a PEP4 polypeptide, a truncated PEP1 polypeptide, or a fusion polypeptide that has at least one activity of a PEP4 polypeptide. In some embodiments, the nucleotide sequence is codon-optimized.

Exemplary heterologous nucleic acids disclosed herein may include nucleic acids comprising a nucleotide sequence that encodes an IRE1 polypeptide, such as, a full-length IRE1 polypeptide, a fragment of an IRE1 polypeptide (e.g., missing the first 7 amino acids), a variant of an IRE1 polypeptide, a truncated IRE1 polypeptide, or a fusion polypeptide that has at least one activity of an IRE1 polypeptide. In some embodiments, the nucleotide sequence is codon-optimized.

In some embodiments, one or more secretory pathway polypeptides, such as a KAR2 polypeptide, a PDI1 polypeptide, an ERO1 polypeptide, a FAD1 polypeptide, or an IRE1 polypeptide, are overexpressed in the modified host cell. Overexpression may be achieved by increasing the copy number of the one or more heterologous nucleic acids comprising nucleotide sequences encoding one or more secretory pathway polypeptides, such as a KAR2 polypeptide, a PDI1 polypeptide, an ERO1 polypeptide, a FAD1 polypeptide, or an IRE1 polypeptide, e.g., through use of a high copy number expression vector (e.g., a plasmid that exists at 10-40 copies or about 100 copies per cell) and/or by operably linking the nucleotide sequences encoding the one or more secretory pathway polypeptides, such as a KAR2 polypeptide, a PDI1 polypeptide, an ERO1 polypeptide, a FAD1 polypeptide, or an IRE1 polypeptide, to a strong promoter. In some embodiments, the modified host cell has one copy of a heterologous nucleic acid comprising a nucleotide sequence encoding a secretory pathway polypeptide, such as a KAR2 polypeptide, a PDI1 polypeptide, an ERO1 polypeptide, a FAD1 polypeptide, or an IRE1 polypeptide. In some embodiments, the modified host cell has two copies of a heterologous nucleic acid comprising a nucleotide sequence encoding a secretory pathway polypeptide, such as a KAR2 polypeptide, a PDI1 polypeptide, an ERO1 polypeptide, a FAD1 polypeptide, or an IRE1 polypeptide. In some embodiments, the modified host cell has three copies of a heterologous nucleic acid comprising a nucleotide sequence encoding a secretory pathway polypeptide, such as a KAR2 polypeptide, a PDI1 polypeptide, an ERO1 polypeptide, a FAD1 polypeptide, or an IRE1 polypeptide. In some embodiments, the modified host cell has four copies of a heterologous nucleic acid comprising a nucleotide sequence encoding a secretory pathway polypeptide, such as a KAR2 polypeptide, a PDI1 polypeptide, an ERO1 polypeptide, a FAD1 polypeptide, or an IRE1 polypeptide. In some embodiments, the modified host cell has five copies of a heterologous nucleic acid comprising a nucleotide sequence encoding a secretory pathway polypeptide, such as a KAR2 polypeptide, a PDI1 polypeptide, an ERO1 polypeptide, a FAD1 polypeptide, or an IRE1 polypeptide. In some embodiments, the modified host cell has five or more copies of a heterologous nucleic acid comprising a nucleotide sequence encoding a secretory pathway polypeptide, such as a KAR2 polypeptide, a PDI1 polypeptide, an ERO1 polypeptide, a FAD1 polypeptide, or an IRE1 polypeptide. Increased copy number of the heterologous nucleic acid and/or codon optimization of the nucleotide sequence may result in an increase in the desired polypeptide activity in the modified host cell.

In some embodiments, the modified host cells of the disclosure comprise one or more heterologous nucleic acids comprising nucleotide sequences encoding one or more secretory pathway polypeptides selected from the group consisting of nucleotide sequences set forth in SEQ ID NO:4 (encodes a KAR2 polypeptide), SEQ ID NO:8 (encodes a PDI1 polypeptide), SEQ ID NO:6 (encodes an ERO1 polypeptide), SEQ ID NO:297 (encodes a FAD1 polypeptide), SEQ ID NO:10 (encodes an IRE1 polypeptide), and SEQ ID NO:295 (encodes an IRE1 polypeptide fragment).

In some embodiments, the modified host cells of the disclosure comprise one or more heterologous nucleic acids comprising nucleotide sequences encoding one or more secretory pathway polypeptides selected from the group consisting of nucleotide sequences set forth in SEQ ID NO:4 (encodes a KAR2 polypeptide), SEQ ID NO:8 (encodes a PDI1 polypeptide), SEQ ID NO:6 (encodes an ERO1 polypeptide), SEQ ID NO:297 (encodes a FAD1 polypeptide), SEQ ID NO:10 (encodes an IRE1 polypeptide), and SEQ ID NO:295 (an IRE1 polypeptide fragment), or a codon degenerate nucleotide sequence of any of the foregoing.

In some embodiments, the modified host cells of the disclosure comprise one or more heterologous nucleic acids comprising nucleotide sequences encoding one or more secretory pathway polypeptides selected from the group consisting of nucleotide sequences having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:4 (encodes a KAR2 polypeptide), SEQ ID NO:8 (encodes a PDI1 polypeptide), SEQ ID NO:6 (encodes an ERO1 polypeptide), SEQ ID NO:297 (encodes a FAD1 polypeptide), SEQ ID NO:10 (encodes an IRE1 polypeptide), and SEQ ID NO:295 (an IRE1 polypeptide fragment).

In some embodiments, the modified host cells of the disclosure comprise a deletion or downregulation of one or more genes encoding one or more secretory pathway polypeptides encoded by nucleotide sequences selected from the group consisting of nucleotide sequences set forth in SEQ ID NO:12 (encodes a ROT2 polypeptide) and SEQ ID NO:14 (encodes a PEP4 polypeptide).

In some embodiments, the modified host cells of the disclosure comprise a deletion or downregulation of a ROT2 gene. In some embodiments, the modified host cells of the disclosure comprise a deletion of a ROT2 gene. In some embodiments, the modified host cells of the disclosure comprise a downregulation of a ROT2 gene.

In some embodiments, the modified host cells of the disclosure comprise a deletion or downregulation of a PEP4 gene. In some embodiments, the modified host cells of the disclosure comprise a deletion of a PEP4 gene. In some embodiments, the modified host cells of the disclosure comprise a downregulation of a PEP4 gene.

In some embodiments, the modified host cells of the disclosure comprise a deletion or downregulation of a PEP4 gene and a ROT2 gene. In some embodiments, the modified host cells of the disclosure comprise a deletion of a PEP4 gene and a ROT2 gene. In some embodiments, the modified host cells of the disclosure comprise a downregulation of a PEP4 gene and a ROT2 gene.

Cannabinoid and Cannabinoid Precursor Biosynthetic Pathway Modifications

A modified host cell of the present disclosure comprising one or more nucleic acids comprising a nucleotide sequence encoding an engineered variant of the disclosure may also comprise one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In addition to engineered variants of the disclosure, such polypeptides may include, but are not limited to: a geranyl pyrophosphate: olivetolic acid geranyltransferase (GOT) polypeptide, a tetraketide synthase (TKS) polypeptide, an olivetolic acid cyclase (OAC) polypeptide, one or more polypeptides having at least one activity of a polypeptide present in the mevalonate (MEV) pathway (e.g., one or more MEV pathway polypeptides), an acyl-activating enzyme (AAE) polypeptide, a polypeptide that generates GPP (e.g., a geranyl pyrophosphate synthetase (GPPS) polypeptide), a polypeptide that condenses two molecules of acetyl-CoA to generate acetoacetyl-CoA (e.g., an acetoacetyl-CoA thiolase polypeptide), and a pyruvate decarboxylase polypeptide. In some embodiments, the nucleotide sequences encoding the one or more polypeptides involved in cannabinoid or cannabinoid precursor (e.g., geranylpyrophosphate (GPP), prenyl phosphates, olivetolic acid, or hexanoyl-CoA) biosynthesis are codon-optimized.

The polypeptides involved in cannabinoid or cannabinoid precursor biosynthesis and the nucleotide sequences encoding the polypeptides involved in cannabinoid or cannabinoid precursor biosynthesis may be derived from any suitable source, for example, bacteria, yeast, fungi, algae, human, plant (e.g., *Cannabis*), or mouse. In some embodiments, the disclosure also encompasses orthologous genes encoding the polypeptides involved in cannabinoid or cannabinoid precursor biosynthesis disclosed herein. Exemplary polypeptides involved in cannabinoid or cannabinoid precursor biosynthesis disclosed herein may also include a full-length polypeptide involved in cannabinoid or cannabinoid precursor biosynthesis, a fragment of a polypeptide involved in cannabinoid or cannabinoid precursor biosynthesis, a variant of a polypeptide involved in cannabinoid or cannabinoid precursor biosynthesis, a truncated polypeptide involved in cannabinoid or cannabinoid precursor biosynthesis, or a fusion polypeptide that has at least one activity of a polypeptide involved in cannabinoid or cannabinoid precursor biosynthesis. The disclosure also provides for nucleotide sequences encoding polypeptides involved in cannabinoid or cannabinoid precursor biosynthesis, such as, a full-length polypeptide involved in cannabinoid or cannabinoid precursor biosynthesis, a fragment of a polypeptide involved in cannabinoid or cannabinoid precursor biosynthesis, a variant of a polypeptide involved in cannabinoid or cannabinoid precursor biosynthesis, a truncated polypeptide involved in cannabinoid or cannabinoid precursor biosynthesis, or a fusion polypeptide that has at least one activity of a polypeptide involved in cannabinoid or cannabinoid precursor biosynthesis. In some embodiments, the nucleotide sequences encoding the polypeptides involved in cannabinoid or cannabinoid precursor biosynthesis are codon-optimized.

Engineered Variants of the Cannabidiolic Acid Synthase (CBDAS) Polypeptide

A modified host cell of the present disclosure may comprise one or more nucleic acids comprising a nucleotide sequence encoding an engineered variant of the cannabidiolic acid synthase (CBDAS) polypeptide disclosed herein. In certain such embodiments, the cannabidiolic acid synthase polypeptide has an amino acid sequence of SEQ ID NO:3.

In some embodiments, a modified host cell of the disclosure comprises one or more nucleic acids comprising a nucleotide sequence encoding an engineered variant of the disclosure, wherein the engineered variant comprises the amino acid sequence set forth in SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, or SEQ ID NO:234. In some embodiments, the nucleotide sequence is codon-optimized.

In some embodiments, a modified host cell of the disclosure comprises one or more nucleic acids comprising a nucleotide sequence encoding an engineered variant of the disclosure, wherein the engineered variant comprises the amino acid sequence set forth in SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:300, SEQ ID NO:302, or SEQ ID NO:304. In some embodiments, the nucleotide sequence is codon-optimized.

In some embodiments, a modified host cell of the disclosure comprises one or more nucleic acids comprising a nucleotide sequence encoding an engineered variant of the disclosure, wherein the engineered variant comprises the amino acid sequence set forth in SEQ ID NO:60, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:88, SEQ ID NO:90, SEQ ID NO:92, SEQ ID NO:96, SEQ ID NO:102, SEQ ID NO:106, SEQ ID NO:112, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, or SEQ ID NO:234. In some embodiments, the nucleotide sequence is codon-optimized.

In some embodiments, a modified host cell of the disclosure comprises one or more nucleic acids comprising a nucleotide sequence encoding an engineered variant of the disclosure, wherein the engineered variant comprises the amino acid sequence set forth in SEQ ID NO:66, SEQ ID NO:70, SEQ ID NO:72, SEQ ID NO:80, SEQ ID NO:82, SEQ ID NO:130, SEQ ID NO:136, SEQ ID NO:142, SEQ ID NO:146, SEQ ID NO:150, SEQ ID NO:156, SEQ ID NO:158, SEQ ID NO:160, SEQ ID NO:168, SEQ ID NO:170, SEQ ID NO:172, SEQ ID NO:176, SEQ ID NO:182, SEQ ID NO:184, SEQ ID NO:186, SEQ ID NO:190, SEQ ID NO:192, SEQ ID NO:194, SEQ ID NO:196, SEQ ID NO:198, SEQ ID NO:206, SEQ ID NO:214, SEQ ID NO:216, SEQ ID NO:218, SEQ ID NO:230, or SEQ ID NO:232. In some embodiments, the nucleotide sequence is codon-optimized.

In some embodiments, a modified host cell of the disclosure comprises one or more nucleic acids comprising a nucleotide sequence encoding an engineered variant of the disclosure, wherein the engineered variant comprises the amino acid sequence set forth in SEQ ID NO:60, SEQ ID NO:64, SEQ ID NO:66, SEQ ID NO:68, SEQ ID NO:70, SEQ ID NO:72, SEQ ID NO:80, SEQ ID NO:82, SEQ ID NO:102, SEQ ID NO:104, SEQ ID NO:106, SEQ ID NO:116, SEQ ID NO:118, SEQ ID NO:120, SEQ ID NO:122, SEQ ID NO:124, SEQ ID NO:130, SEQ ID NO:132, SEQ ID NO:134, SEQ ID NO:136, SEQ ID NO:138, SEQ ID NO:140, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:224, SEQ ID NO:226, SEQ ID NO:228, SEQ ID NO:230, SEQ ID NO:232, or SEQ ID NO:234. In some embodiments, the nucleotide sequence is codon-optimized.

In some embodiments, a modified host cell of the disclosure comprises one or more nucleic acids comprising a nucleotide sequence encoding an engineered variant of the disclosure, wherein the engineered variant comprises the amino acid sequence set forth in SEQ ID NO:222, SEQ ID NO:224, SEQ ID NO:226, SEQ ID NO:228, SEQ ID NO:230, SEQ ID NO:232, or SEQ ID NO:234. In some embodiments, the nucleotide sequence is codon-optimized.

In some embodiments, a modified host cell of the disclosure comprises one or more nucleic acids comprising a nucleotide sequence encoding an engineered variant of the disclosure, wherein the engineered variant comprises the amino acid sequence set forth in SEQ ID NO:60, SEQ ID NO:82, SEQ ID NO:92, SEQ ID NO:104, SEQ ID NO:156, SEQ ID NO:160, SEQ ID NO:162, SEQ ID NO:172, SEQ ID NO:174, SEQ ID NO:176, SEQ ID NO:184, SEQ ID NO:198, SEQ ID NO:202, or SEQ ID NO:230. In some embodiments, the nucleotide sequence is codon-optimized.

In some embodiments, a modified host cell of the disclosure comprises one or more nucleic acids comprising a nucleotide sequence encoding an engineered variant of the disclosure, wherein the engineered variant comprises the amino acid sequence set forth in SEQ ID NO:82, SEQ ID NO:156, SEQ ID NO:160, SEQ ID NO:172, SEQ ID NO:176, SEQ ID NO:184, or SEQ ID NO:198. In some embodiments, the nucleotide sequence is codon-optimized.

In some embodiments, a modified host cell of the disclosure comprises one or more nucleic acids comprising a nucleotide sequence encoding an engineered variant of the disclosure, wherein the engineered variant comprises the amino acid sequence set forth in SEQ ID NO:300, SEQ ID NO:302, or SEQ ID NO:304. In some embodiments, a modified host cell of the disclosure comprises one or more nucleic acids comprising a nucleotide sequence encoding an engineered variant of the disclosure, wherein the engineered variant comprises the amino acid sequence set forth in SEQ ID NO:300. In some embodiments, the nucleotide sequence is codon-optimized.

In some embodiments, a modified host cell of the disclosure comprises one or more nucleic acids comprising a nucleotide sequence encoding an engineered variant of the disclosure, wherein the engineered variant comprises the amino acid sequence set forth in SEQ ID NO:314, SEQ ID NO:316, SEQ ID NO:318, or SEQ ID NO:320. In some embodiments, a modified host cell of the disclosure comprises one or more nucleic acids comprising a nucleotide sequence encoding an engineered variant of the disclosure, wherein the engineered variant comprises the amino acid sequence set forth in SEQ ID NO:314. In some embodiments, a modified host cell of the disclosure comprises one or more nucleic acids comprising a nucleotide sequence encoding an engineered variant of the disclosure, wherein the engineered variant comprises the amino acid sequence set forth in SEQ ID NO:316. In some embodiments, a modified host cell of the disclosure comprises one or more nucleic acids comprising a nucleotide sequence encoding an engineered variant of the disclosure, wherein the engineered variant comprises the amino acid sequence set forth in SEQ ID NO:318. In some embodiments, a modified host cell of the disclosure comprises one or more nucleic acids comprising a nucleotide sequence encoding an engineered variant of the disclosure, wherein the engineered variant comprises the amino acid sequence set forth in SEQ ID NO:320. In some embodiments, the nucleotide sequence is codon-optimized.

In some embodiments, the engineered variant of the disclosure is overexpressed in the modified host cell. Overexpression may be achieved by increasing the copy number of the one or more nucleic acids comprising a nucleotide sequence encoding the engineered variant of the disclosure, e.g., through use of a high copy number expression vector (e.g., a plasmid that exists at 10-40 copies or about 100 copies per cell) and/or by operably linking the nucleotide sequence encoding the engineered variant of the disclosure to a strong promoter. In some embodiments, the modified host cell has one copy of a nucleic acid comprising a nucleotide sequence encoding the engineered variant of the disclosure. In some embodiments, the modified host cell has two copies of a nucleic acid comprising a nucleotide sequence encoding the engineered variant of the disclosure. In some embodiments, the modified host cell has three copies of a nucleic acid comprising a nucleotide sequence encoding the engineered variant of the disclosure. In some embodiments, the modified host cell has four copies of a nucleic acid comprising a nucleotide sequence encoding the engineered variant of the disclosure. In some embodiments, the modified host cell has five copies of a nucleic acid comprising a nucleotide sequence encoding the engineered variant of the disclosure. In some embodiments, the modified host cell has six copies of a nucleic acid comprising a nucleotide sequence encoding the engineered variant of the disclosure. In some embodiments, the modified host cell has seven copies of a nucleic acid comprising a nucleotide sequence encoding the engineered variant of the disclosure. In some embodiments, the modified host cell has eight copies of a nucleic acid comprising a nucleotide sequence encoding the engineered variant of the disclosure. In some embodiments, the modified host cell has eight or more copies of a nucleic acid comprising a nucleotide sequence encoding the engineered variant of the disclosure. Increased copy number of the nucleic acid and/or codon optimization of the nucleotide sequence may result in an increase in the desired enzyme catalytic activity in the modified host cell.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, or SEQ ID NO:233. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, or SEQ ID NO:233, or a codon degenerate nucleotide sequence of any of the foregoing. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:299, SEQ ID NO:301, or SEQ ID NO:303. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:299, SEQ ID NO:301, or SEQ ID NO:303, or a codon degenerate nucleotide sequence of any of the foregoing. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:59, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:87, SEQ ID NO:89, SEQ ID NO:91, SEQ ID NO:95, SEQ ID NO:101, SEQ ID NO:105, SEQ ID NO:111, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, or SEQ ID NO:233. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:59, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:87, SEQ ID NO:89, SEQ ID NO:91, SEQ ID NO:95, SEQ ID NO:101, SEQ ID NO:105, SEQ ID NO:111, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, or SEQ ID NO:233, or a codon degenerate sequence of any of the foregoing. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:65, SEQ ID NO:69, SEQ ID NO:71, SEQ ID NO:79, SEQ ID NO: 81, SEQ ID NO:129, SEQ ID NO:135, SEQ ID NO:141, SEQ ID NO:145, SEQ ID NO:149, SEQ ID NO:155, SEQ ID NO:157, SEQ ID NO:159, SEQ ID NO:167, SEQ ID NO:169, SEQ ID NO:171, SEQ ID NO:175, SEQ ID NO:181, SEQ ID NO:183, SEQ ID NO:185, SEQ ID NO:189, SEQ ID NO:191, SEQ ID NO:193, SEQ ID NO:195, SEQ ID NO:197, SEQ ID NO:205, SEQ ID NO:213, SEQ ID NO:215, SEQ ID NO:217, SEQ ID NO:229, or SEQ ID NO:231. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:65, SEQ ID NO:69, SEQ ID NO:71, SEQ ID NO:79, SEQ ID NO: 81, SEQ ID NO:129, SEQ ID NO:135, SEQ ID NO:141, SEQ ID NO:145, SEQ ID NO:149, SEQ ID NO:155, SEQ ID NO:157, SEQ ID NO:159, SEQ ID NO:167, SEQ ID NO:169, SEQ ID NO:171, SEQ ID NO:175, SEQ ID NO:181, SEQ ID NO:183, SEQ ID NO:185, SEQ ID NO:189, SEQ ID NO:191, SEQ ID NO:193, SEQ ID NO:195, SEQ ID NO:197, SEQ ID NO:205, SEQ ID NO:213, SEQ ID NO:215, SEQ ID NO:217, SEQ ID NO:229, or SEQ ID NO:231, or a codon degenerate sequence of any of the foregoing. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:221, SEQ ID NO:223, SEQ ID NO:225, SEQ ID NO:227, SEQ ID NO:229, SEQ ID NO:231, or SEQ ID NO:233. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:221, SEQ ID NO:223, SEQ ID NO:225, SEQ ID NO:227, SEQ ID NO:229, SEQ ID NO:231, or SEQ ID NO:233, or a codon degenerate nucleotide sequence of any of the foregoing. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:59, SEQ ID NO:63, SEQ ID NO:65, SEQ ID NO:67, SEQ ID NO:69, SEQ ID NO:71, SEQ ID NO:79, SEQ ID NO:81, SEQ ID NO:101, SEQ ID NO:103, SEQ ID NO:105, SEQ ID NO:115, SEQ ID NO:117, SEQ ID NO:119, SEQ ID NO:121, SEQ ID NO:123, SEQ ID NO:129, SEQ ID NO:131, SEQ ID NO:133, SEQ ID NO:135, SEQ ID NO:137, SEQ ID NO:139, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:223, SEQ ID NO:225, SEQ ID NO:227, SEQ ID NO:229, SEQ ID NO:231, or SEQ ID NO:233. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:59, SEQ ID NO:63, SEQ ID NO:65, SEQ ID NO:67, SEQ ID NO:69, SEQ ID NO:71, SEQ ID NO:79, SEQ ID NO:81, SEQ ID NO:101, SEQ ID NO:103, SEQ ID NO:105, SEQ ID NO:115, SEQ ID NO:117, SEQ ID NO:119, SEQ ID NO:121, SEQ ID NO:123, SEQ ID NO:129, SEQ ID NO:131, SEQ ID NO:133, SEQ ID NO:135, SEQ ID NO:137, SEQ ID NO:139, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:223, SEQ ID NO:225, SEQ ID NO:227, SEQ ID NO:229, SEQ ID NO:231, or SEQ ID NO:233, or a codon degenerate sequence of any of the foregoing. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:59, SEQ ID NO:81, SEQ ID NO:91, SEQ ID NO:103, SEQ ID NO:155, SEQ ID NO:159, SEQ ID NO:161, SEQ ID NO:171, SEQ ID NO:173, SEQ ID NO:175, SEQ ID NO:183, SEQ ID NO:197, SEQ ID NO:201, or SEQ ID NO:229. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:59, SEQ ID NO:81, SEQ ID NO:91, SEQ ID NO:103, SEQ ID NO:155, SEQ ID NO:159, SEQ ID NO:161, SEQ ID NO:171, SEQ ID NO:173, SEQ ID NO:175, SEQ ID NO:183, SEQ ID NO:197, SEQ ID NO:201, or SEQ ID NO:229, or a codon degenerate sequence of any of the foregoing. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:81, SEQ ID NO:155, SEQ ID NO:159, SEQ ID NO:171, SEQ ID NO:175, SEQ ID NO:183, or SEQ ID NO:197. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:81, SEQ ID NO:155, SEQ ID NO:159, SEQ ID NO:171, SEQ ID NO:175, SEQ ID NO:183, or SEQ ID NO:197, or a codon degenerate sequence of any of the foregoing. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:299, SEQ ID NO:301, or SEQ ID NO:303. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:299, SEQ ID NO:301, or SEQ ID NO:303, or a codon degenerate nucleotide sequence of any of the foregoing. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:299. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:299, or a codon degenerate nucleotide sequence of any of the foregoing. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:313, SEQ ID NO:315, SEQ ID NO:317, or SEQ ID NO:319. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:313, SEQ ID NO:315, SEQ ID NO:317, or SEQ ID NO:319, or a codon degenerate nucleotide sequence of any of the foregoing. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:313. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:313, or a codon degenerate nucleotide sequence of any of the foregoing. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:315. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:315, or a codon degenerate nucleotide sequence of any of the foregoing. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:317. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:317, or a codon degenerate nucleotide sequence of any of the foregoing. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:319. In some embodiments, the nucleotide sequence is codon-optimized.

In some embodiments, a modified host cell of the disclosure comprises one or more nucleic acids comprising a nucleotide sequence encoding an engineered variant of the cannabidiolic acid synthase (CBDAS) polypeptide disclosed herein, wherein the nucleotide sequence is that set forth in SEQ ID NO:319, or a codon degenerate nucleotide sequence of any of the foregoing. In some embodiments, the nucleotide sequence is codon-optimized.

In some embodiments, at least one of the one or more nucleic acids comprising a nucleotide sequence encoding the engineered variant of the disclosure is operably linked to an inducible promoter. In some embodiments, at least one of the one or more nucleic acids comprising a nucleotide sequence encoding the engineered variant of the disclosure is operably linked to a constitutive promoter.

Geranyl Pyrophosphate: Olivetolic Acid Geranyltransferase (GOT) Polypeptides

A modified host cell of the present disclosure may comprise one or more heterologous nucleic acids comprising a nucleotide sequence encoding a geranyl pyrophosphate: olivetolic acid geranyltransferase (GOT) polypeptide.

Exemplary GOT polypeptides disclosed herein may include a full-length GOT polypeptide, a fragment of a GOT polypeptide, a variant of a GOT polypeptide, a truncated GOT polypeptide, or a fusion polypeptide that has at least one activity of a GOT polypeptide. In some embodiments, the GOT polypeptide has aromatic prenyltransferase (PT) activity. In some embodiments, the GOT polypeptide modifies a cannabinoid precursor or a cannabinoid precursor derivative. In certain such embodiments, the GOT polypeptide modifies olivetolic acid or an olivetolic acid derivative.

In some embodiments, a modified host cell of the disclosure comprises one or more heterologous nucleic acids comprising a nucleotide sequence encoding a GOT polypeptide, wherein the GOT polypeptide comprises the amino acid sequence set forth in SEQ ID NO:17. In some embodiments, a modified host cell of the disclosure comprises one or more heterologous nucleic acids comprising a nucleotide sequence encoding a GOT polypeptide, wherein the GOT polypeptide comprises the amino acid sequence set forth in SEQ ID NO:17, or a conservatively substituted amino acid sequence thereof. In some embodiments, a modified host cell of the disclosure comprises one or more heterologous nucleic acids comprising a nucleotide sequence encoding a GOT polypeptide, wherein the GOT polypeptide comprises an amino acid sequence having at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:17.

In some embodiments, a modified host cell of the disclosure comprises one or more heterologous nucleic acids comprising a nucleotide sequence encoding a GOT polypeptide, wherein the GOT polypeptide comprises an amino acid sequence having at least 65%, at least 70%, or at least 75% amino acid sequence identity to SEQ ID NO:17. In some embodiments, a modified host cell of the disclosure comprises one or more heterologous nucleic acids comprising a nucleotide sequence encoding a GOT polypeptide, wherein the GOT polypeptide comprises an amino acid sequence having at least 80%, at least 81%, at least 82%, at least 83%, or at least 84% amino acid sequence identity to SEQ ID NO:17. In some embodiments, a modified host cell of the disclosure comprises one or more heterologous nucleic acids comprising a nucleotide sequence encoding a GOT polypeptide, wherein the GOT polypeptide comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:17.

Exemplary heterologous nucleic acids disclosed herein may include nucleic acids comprising a nucleotide sequence that encodes a GOT polypeptide, such as, a full-length GOT polypeptide, a fragment of a GOT polypeptide, a variant of a GOT polypeptide, a truncated GOT polypeptide, or a fusion polypeptide that has at least one activity of a GOT polypeptide. In some embodiments, the nucleotide sequence is codon-optimized.

In some embodiments, the GOT polypeptide is overexpressed in the modified host cell. Overexpression may be achieved by increasing the copy number of the one or more heterologous nucleic acids comprising a nucleotide sequence encoding the GOT polypeptide, e.g., through use of a high copy number expression vector (e.g., a plasmid that exists at 10-40 copies or about 100 copies per cell) and/or by operably linking the nucleotide sequence encoding the GOT polypeptide to a strong promoter. In some embodiments, the modified host cell has one copy of a heterologous nucleic acid comprising a nucleotide sequence encoding the GOT polypeptide. In some embodiments, the modified host cell has two copies of a heterologous nucleic acid comprising a nucleotide sequence encoding the GOT polypeptide. In some embodiments, the modified host cell has three copies of a heterologous nucleic acid comprising a nucleotide sequence encoding the GOT polypeptide. In some embodiments, the modified host cell has four copies of a heterologous nucleic acid comprising a nucleotide sequence encoding the GOT polypeptide. In some embodiments, the modified host cell has five copies of a heterologous nucleic acid comprising a nucleotide sequence encoding the GOT polypeptide. In some embodiments, the modified host cell has six copies of a heterologous nucleic acid comprising a nucleotide sequence encoding the GOT polypeptide. In some embodiments, the modified host cell has seven copies of a heterologous nucleic acid comprising a nucleotide sequence encoding the GOT polypeptide. In some embodiments, the modified host cell has eight copies of a heterologous nucleic acid comprising a nucleotide sequence encoding the GOT polypeptide. In some embodiments, the modified host cell has eight or more copies of a heterologous nucleic acid comprising a nucleotide sequence encoding the GOT polypeptide. Increased copy number of the heterologous nucleic acid and/or codon optimization of the nucleotide sequence may result in an increase in the desired enzyme catalytic activity in the modified host cell.

In some embodiments, a modified host cell of the disclosure comprises one or more heterologous nucleic acids comprising a nucleotide sequence encoding a GOT polypeptide, wherein the nucleotide sequence is that set forth in SEQ ID NO:16. In some embodiments, a modified host cell of the disclosure comprises one or more heterologous nucleic acids comprising a nucleotide sequence encoding a GOT polypeptide, wherein the nucleotide sequence is that set forth in SEQ ID NO:16, or a codon degenerate nucleotide sequence thereof. In some embodiments, a modified host cell of the disclosure comprises one or more heterologous nucleic acids comprising a nucleotide sequence encoding a GOT polypeptide, wherein the nucleotide sequence has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:16.

In some embodiments, a modified host cell of the disclosure comprises one or more heterologous nucleic acids comprising a nucleotide sequence encoding a GOT polypeptide, wherein the nucleotide sequence has at least 80%, at least 81%, at least 82%, at least 83%, or at least 84% sequence identity to SEQ ID NO:16. In some embodiments, a modified host cell of the disclosure comprises one or more heterologous nucleic acids comprising a nucleotide sequence encoding a GOT polypeptide, wherein the nucleotide sequence has at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:16.

In some embodiments, a modified host cell of the disclosure comprises one or more heterologous nucleic acids comprising a nucleotide sequence encoding a GOT polypeptide, wherein the nucleotide sequence has at least 80% sequence identity to SEQ ID NO:16. In some embodiments, a modified host cell of the disclosure comprises one or more heterologous nucleic acids comprising a nucleotide sequence encoding a GOT polypeptide, wherein the nucleotide sequence has at least 85% sequence identity to SEQ ID NO:16. In some embodiments, a modified host cell of the disclosure comprises one or more heterologous nucleic acids comprising a nucleotide sequence encoding a GOT polypeptide, wherein the nucleotide sequence has at least 90% sequence identity to SEQ ID NO:16. In some embodiments, a modified host cell of the disclosure comprises one or more heterologous nucleic acids comprising a nucleotide sequence encoding a GOT polypeptide, wherein the nucleotide sequence has at least 95% sequence identity to SEQ ID NO:16.

NphB Polypeptides

In some embodiments, a NphB polypeptide is used instead of a GOT polypeptide to generate cannabigerolic acid from GPP and olivetolic acid. A modified host cell of the present disclosure may comprise one or more heterologous nucleic acids comprising a nucleotide sequence encoding a NphB polypeptide.

Exemplary NphB polypeptides disclosed herein may include a full-length NphB polypeptide, a fragment of a NphB polypeptide, a variant of a NphB polypeptide, a truncated NphB polypeptide, or a fusion polypeptide that has at least one activity of a NphB polypeptide. In some embodiments, the NphB polypeptide has aromatic prenyltransferase (PT) activity. In some embodiments, the NphB polypeptide modifies a cannabinoid precursor or a cannabinoid precursor derivative. In certain such embodiments, the NphB polypeptide modifies olivetolic acid or an olivetolic acid derivative.

In some embodiments, a modified host cell of the disclosure comprises one or more heterologous nucleic acids comprising a nucleotide sequence encoding a NphB polypeptide, wherein the NphB polypeptide comprises the amino acid sequence set forth in SEQ ID NO:294. In some embodiments, a modified host cell of the disclosure comprises one or more heterologous nucleic acids comprising a nucleotide sequence encoding a NphB polypeptide, wherein the NphB polypeptide comprises the amino acid sequence set forth in SEQ ID NO:294, or a conservatively substituted amino acid sequence thereof. In some embodiments, a modified host cell of the disclosure comprises one or more heterologous nucleic acids comprising a nucleotide sequence encoding a NphB polypeptide, wherein the NphB polypeptide comprises an amino acid sequence having at least 65%, at least 70%, or at least 75% amino acid sequence identity to SEQ ID NO:294. In some embodiments, a modified host cell of the disclosure comprises one or more heterologous nucleic acids comprising a nucleotide sequence encoding a NphB polypeptide, wherein the NphB polypeptide comprises an amino acid sequence having at least 80%, at least 81%, at least 82%, at least 83%, or at least 84% amino acid sequence identity to SEQ ID NO:294. In some embodiments, a modified host cell of the disclosure comprises one or more heterologous nucleic acids comprising a nucleotide sequence encoding a NphB polypeptide, wherein the NphB polypeptide comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:294.

Exemplary heterologous nucleic acids disclosed herein may include nucleic acids comprising a nucleotide sequence that encodes a NphB polypeptide, such as, a full-length NphB polypeptide, a fragment of a NphB polypeptide, a variant of a NphB polypeptide, a truncated NphB polypeptide, or a fusion polypeptide that has at least one activity of a NphB polypeptide. In some embodiments, the nucleotide sequence is codon-optimized.

In some embodiments, the NphB polypeptide is overexpressed in the modified host cell. Overexpression may be achieved by increasing the copy number of the one or more heterologous nucleic acids comprising a nucleotide sequence encoding the NphB polypeptide, e.g., through use of a high copy number expression vector (e.g., a plasmid that exists at 10-40 copies or about 100 copies per cell) and/or by operably linking the nucleotide sequence encoding the NphB polypeptide to a strong promoter. In some embodiments, the modified host cell has one copy of a heterologous nucleic acid comprising a nucleotide sequence encoding the NphB polypeptide. In some embodiments, the modified host cell has two copies of a heterologous nucleic acid comprising a nucleotide sequence encoding the NphB polypeptide. In some embodiments, the modified host cell has three copies of a heterologous nucleic acid comprising a nucleotide sequence encoding the NphB polypeptide. In some embodiments, the modified host cell has four copies of a heterologous nucleic acid comprising a nucleotide sequence encoding the NphB polypeptide. In some embodiments, the modified host cell has five copies of a heterologous nucleic acid comprising a nucleotide sequence encoding the NphB polypeptide. In some embodiments, the modified host cell has six copies of a heterologous nucleic acid comprising a nucleotide sequence encoding the NphB polypeptide. In some embodiments, the modified host cell has seven copies of a heterologous nucleic acid comprising a nucleotide sequence encoding the NphB polypeptide. In some embodiments, the modified host cell has eight copies of a heterologous nucleic acid comprising a nucleotide sequence encoding the NphB polypeptide. In some embodiments, the modified host cell has eight or more copies of a heterologous nucleic acid comprising a nucleotide sequence encoding the NphB polypeptide. Increased copy number of the heterologous nucleic acid and/or codon optimization of the nucleotide sequence may result in an increase in the desired enzyme catalytic activity in the modified host cell.

In some embodiments, a modified host cell of the disclosure comprises one or more heterologous nucleic acids comprising a nucleotide sequence encoding a NphB polypeptide, wherein the nucleotide sequence is that set forth in SEQ ID NO:293. In some embodiments, a modified host cell of the disclosure comprises one or more heterologous nucleic acids comprising a nucleotide sequence encoding a NphB polypeptide, wherein the nucleotide sequence is that set forth in SEQ ID NO:293, or a codon degenerate nucleotide sequence thereof. In some embodiments, a modified host cell of the disclosure comprises one or more heterologous nucleic acids comprising a nucleotide sequence encoding a NphB polypeptide, wherein the nucleotide sequence has at least 80%, at least 81%, at least 82%, at least 83%, or at least 84% sequence identity to SEQ ID NO:293. In some embodiments, a modified host cell of the disclosure comprises one or more heterologous nucleic acids comprising a nucleotide sequence encoding a NphB polypeptide, wherein the nucleotide sequence has at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:293.

In some embodiments, a modified host cell of the disclosure comprises one or more heterologous nucleic acids comprising a nucleotide sequence encoding a NphB polypeptide, wherein the nucleotide sequence has at least 80% sequence identity to SEQ ID NO:293. In some embodiments, a modified host cell of the disclosure comprises one or more heterologous nucleic acids comprising a nucleotide sequence encoding a NphB polypeptide, wherein the nucleotide sequence has at least 85% sequence identity to SEQ ID NO:293. In some embodiments, a modified host cell of the disclosure comprises one or more heterologous nucleic acids comprising a nucleotide sequence encoding a NphB polypeptide, wherein the nucleotide sequence has at least 90% sequence identity to SEQ ID NO:293. In some embodiments, a modified host cell of the disclosure comprises one or more heterologous nucleic acids comprising a nucleotide sequence encoding a NphB polypeptide, wherein the nucleotide sequence has at least 95% sequence identity to SEQ ID NO:293.

Polypeptides that Generate Acyl-CoA Compounds or Acyl-CoA Compound Derivatives

A modified host cell of the present disclosure may comprise one or more heterologous nucleic acids comprising a nucleotide sequence encoding a polypeptide that generates acyl-CoA compounds or acyl-CoA compound derivatives. Such polypeptides may include, but are not limited to, acyl-activating enzyme (AAE) polypeptides, fatty acyl-CoA synthetases (FAA) polypeptides, or fatty acyl-CoA ligase polypeptides. In some embodiments, a modified host cell of the present disclosure comprises one or more heterologous nucleic acids comprising a nucleotide sequence encoding an AAE polypeptide.

AAE polypeptides, FAA polypeptides, and fatty acyl-CoA ligase polypeptides can convert carboxylic acids to their CoA forms and generate acyl-CoA compounds or acyl-CoA compound derivatives. Promiscuous acyl-activating enzyme polypeptides, such as CsAAE1 and CsAAE3 polypeptides, FAA polypeptides, or fatty acyl-CoA ligase polypeptides, may permit generation of cannabinoid derivatives (e.g., cannabigerolic acid derivatives), as well as cannabinoids (e.g., cannabigerolic acid). In some embodiments, unsubstituted or substituted hexanoic acid or carboxylic acids other than unsubstituted or substituted hexanoic acid are fed to modified host cells expressing an AAE polypeptide, FAA polypeptide, or fatty acyl-CoA ligase polypeptide (e.g., are present in the culture medium in which the cells are grown) to generate hexanoyl-CoA, acyl-CoA compounds, derivatives of hexanoyl-CoA, or derivatives of acyl-CoA compounds. The hexanoyl-CoA, acyl-CoA compounds, derivatives of hexanoyl-CoA, or derivatives of acyl-CoA compounds can then be further utilized by a modified host cell to generate cannabinoids or cannabinoid derivatives. In certain such embodiments, the cell culture medium comprising the modified host cells comprises unsubstituted or substituted hexanoic acid. In some embodiments, the cell culture medium comprising the modified host cells comprises a carboxylic acid other than unsubstituted or substituted hexanoic acid.

Exemplary AAE, FAA, or fatty acyl-CoA ligase polypeptides disclosed herein may include a full-length AAE, FAA, or fatty acyl-CoA ligase polypeptide; a fragment of an AAE, FAA, or fatty acyl-CoA ligase polypeptide; a variant of an AAE, FAA, or fatty acyl-CoA ligase polypeptide; a truncated AAE, FAA, or fatty acyl-CoA ligase polypeptide; or a fusion polypeptide that has at least one activity of an AAE, FAA, or fatty acyl-CoA ligase polypeptide.

In some embodiments, a modified host cell of the disclosure comprises one or more heterologous nucleic acids comprising a nucleotide sequence encoding an AAE polypeptide, wherein the AAE polypeptide comprises the amino acid sequence set forth in SEQ ID NO:23. In some embodiments, a modified host cell of the disclosure comprises one or more heterologous nucleic acids comprising a nucleotide sequence encoding an AAE polypeptide, wherein the AAE polypeptide comprises the amino acid sequence set forth in SEQ ID NO:23, or a conservatively substituted amino acid sequence thereof. In some embodiments, a modified host cell of the disclosure comprises one or more heterologous nucleic acids comprising a nucleotide sequence encoding an AAE polypeptide, wherein the AAE polypeptide comprises an amino acid sequence having at least 50%, at least 55%, at least 60%, at least 65%, at least 70%, or at least 75% amino acid sequence identity to SEQ ID NO:23. In some embodiments, a modified host cell of the disclosure comprises one or more heterologous nucleic acids comprising a nucleotide sequence encoding an AAE polypeptide, wherein the AAE polypeptide comprises an amino acid sequence having at least 80%, at least 81%, at least 82%, at least 83%, or at least 84% amino acid sequence identity to SEQ ID NO:23. In some embodiments, a modified host cell of the disclosure comprises one or more heterologous nucleic acids comprising a nucleotide sequence encoding an AAE polypeptide, wherein the AAE polypeptide comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:23.

Exemplary heterologous nucleic acids disclosed herein may include nucleic acids comprising a nucleotide sequence that encodes an AAE, FAA, or fatty acyl-CoA ligase polypeptide, such as, a full-length AAE, FAA, or fatty acyl-CoA ligase polypeptide; a fragment of an AAE, FAA, or fatty acyl-CoA ligase polypeptide; a variant of an AAE, FAA, or fatty acyl-CoA ligase polypeptide; a truncated AAE, FAA, or fatty acyl-CoA ligase polypeptide; or a fusion polypeptide that has at least one activity of an AAE, FAA, or fatty acyl-CoA ligase polypeptide. In some embodiments, the nucleotide sequence is codon-optimized.

In some embodiments, one or more AAE, FAA, or fatty acyl-CoA ligase polypeptide are overexpressed in the modified host cell. Overexpression may be achieved by increasing the copy number of the one or more heterologous nucleic acids comprising a nucleotide sequence encoding the AAE, FAA, or fatty acyl-CoA ligase polypeptide, e.g., through use of a high copy number expression vector (e.g., a plasmid that exists at 10-40 copies or about 100 copies per cell) and/or by operably linking a nucleotide sequence encoding the AAE, FAA, or fatty acyl-CoA ligase polypeptide to a strong promoter. In some embodiments, the modified host cell has one copy of a heterologous nucleic acid comprising a nucleotide sequence encoding an AAE, FAA, or fatty acyl-CoA ligase polypeptide. In some embodiments, the modified host cell has two copies of a heterologous nucleic acid comprising a nucleotide sequence encoding an AAE, FAA, or fatty acyl-CoA ligase polypeptide. In some embodiments, the modified host cell has three copies of a heterologous nucleic acid comprising a nucleotide sequence encoding an AAE, FAA, or fatty acyl-CoA ligase polypeptide. In some embodiments, the modified host cell has four copies of a heterologous nucleic acid comprising a nucleotide sequence encoding an AAE, FAA, or fatty acyl-CoA ligase polypeptide. In some embodiments, the modified host cell has five copies of a heterologous nucleic acid comprising a nucleotide sequence encoding an AAE, FAA, or fatty acyl-CoA ligase polypeptide. In some embodiments, the modified host cell has six copies of a heterologous nucleic acid comprising a nucleotide sequence encoding an AAE, FAA, or fatty acyl-CoA ligase polypeptide. In some embodiments, the modified host cell has seven copies of a heterologous nucleic acid comprising a nucleotide sequence encoding an AAE, FAA, or fatty acyl-CoA ligase polypeptide. In some embodiments, the modified host cell has eight copies of a heterologous nucleic acid comprising a nucleotide sequence encoding an AAE, FAA, or fatty acyl-CoA ligase polypeptide. In some embodiments, the modified host cell has eight or more copies of a heterologous nucleic acid comprising a nucleotide sequence encoding an AAE, FAA, or fatty acyl-CoA ligase polypeptide. Increased copy number of the heterologous nucleic acid and/or codon optimization of the nucleotide sequence may result in an increase in the desired enzyme catalytic activity in the modified host cell.

In some embodiments, a modified host cell of the disclosure comprises one or more heterologous nucleic acids comprising a nucleotide sequence encoding an AAE polypeptide, wherein the nucleotide sequence is that set forth in SEQ ID NO:22. In some embodiments, a modified host cell of the disclosure comprises one or more heterologous nucleic acids comprising a nucleotide sequence encoding an AAE polypeptide, wherein the nucleotide sequence is that set forth in SEQ ID NO:22, or a codon degenerate nucleotide sequence thereof. In some embodiments, a modified host cell of the disclosure comprises one or more heterologous nucleic acids comprising a nucleotide sequence encoding an AAE polypeptide, wherein the nucleotide sequence has at least 80%, at least 81%, at least 82%, at least 83%, or at least 84% sequence identity to SEQ ID NO:22. In some embodiments, a modified host cell of the disclosure comprises one or more heterologous nucleic acids comprising a nucleotide sequence encoding an AAE polypeptide, wherein the nucleotide sequence has at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:22.

Polypeptides that Condense an Acyl-CoA Compound or an Acyl-CoA Compound Derivative with Malonyl-CoA to Generate Olivetolic Acid or Derivatives of Olivetolic Acid A modified host cell of the present disclosure may comprise one or more heterologous nucleic acids comprising a nucleotide sequence encoding one or more polypeptides that condense an acyl-CoA compound, such as hexanoyl-CoA, or an acyl-CoA compound derivative, such as a hexanoyl-CoA derivative, with malonyl-CoA to generate olivetolic acid, or a derivative of olivetolic acid. Polypeptides that react an acyl-CoA compound or an acyl-CoA compound derivative with malonyl-CoA to generate olivetolic acid, or a derivative of olivetolic acid, may include TKS and OAC polypeptides. TKS and OAC polypeptides have been found to have broad substrate specificity, enabling production of cannabinoid derivatives or cannabinoids. In some embodiments, a modified host cell of the present disclosure comprises one or more heterologous nucleic acids comprising a nucleotide sequence encoding a TKS polypeptide. In some embodiments, a modified host cell of the present disclosure comprises one or more heterologous nucleic acids comprising a nucleotide sequence encoding an OAC polypeptide.

Exemplary TKS or OAC polypeptides disclosed herein may include a full-length TKS or OAC polypeptide, a fragment of a TKS or OAC polypeptide, a variant of a TKS or OAC polypeptide, a truncated TKS or OAC polypeptide, or a fusion polypeptide that has at least one activity of a TKS or OAC polypeptide.

In some embodiments, a modified host cell of the disclosure comprises one or more heterologous nucleic acids comprising a nucleotide sequence encoding a TKS polypeptide, wherein the TKS polypeptide comprises the amino acid sequence set forth in SEQ ID NO:19. In some embodiments, a modified host cell of the disclosure comprises one or more heterologous nucleic acids comprising a nucleotide sequence encoding a TKS polypeptide, wherein the TKS polypeptide comprises the amino acid sequence set forth in SEQ ID NO:19, or a conservatively substituted amino acid sequence thereof. In some embodiments, a modified host cell of the disclosure comprises one or more heterologous nucleic acids comprising a nucleotide sequence encoding a TKS polypeptide, wherein the TKS polypeptide comprises an amino acid sequence having at least 50%, at least 55%, at least 60%, at least 65%, at least 70%, or at least 75% amino acid sequence identity to SEQ ID NO:19. In some embodiments, a modified host cell of the disclosure comprises one or more heterologous nucleic acids comprising a nucleotide sequence encoding a TKS polypeptide, wherein the TKS polypeptide comprises an amino acid sequence having at least 80%, at least 81%, at least 82%, at least 83%, or at least 84% amino acid sequence identity to SEQ ID NO:19. In some embodiments, a modified host cell of the disclosure comprises one or more heterologous nucleic acids comprising a nucleotide sequence encoding a TKS polypeptide, wherein the TKS polypeptide comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:19.

In some embodiments, a modified host cell of the disclosure comprises one or more heterologous nucleic acids comprising a nucleotide sequence encoding an OAC polypeptide, wherein the OAC polypeptide comprises the amino acid sequence set forth in SEQ ID NO:21 or SEQ ID NO:48. In some embodiments, a modified host cell of the disclosure comprises one or more heterologous nucleic acids comprising a nucleotide sequence encoding an OAC polypeptide, wherein the OAC polypeptide comprises the amino acid sequence set forth in SEQ ID NO:21 or SEQ ID NO:48, or a conservatively substituted amino acid sequence thereof. In some embodiments, a modified host cell of the disclosure comprises one or more heterologous nucleic acids comprising a nucleotide sequence encoding an OAC polypeptide, wherein the OAC polypeptide comprises an amino acid sequence having at least 50%, at least 55%, at least 60%, at least 65%, at least 70%, or at least 75% amino acid sequence identity to SEQ ID NO:21 or SEQ ID NO:48. In some embodiments, a modified host cell of the disclosure comprises one or more heterologous nucleic acids comprising a nucleotide sequence encoding an OAC polypeptide, wherein the OAC polypeptide comprises an amino acid sequence having at least 80%, at least 81%, at least 82%, at least 83%, or at least 84% amino acid sequence identity to SEQ ID NO:21 or SEQ ID NO:48. In some embodiments, a modified host cell of the disclosure comprises one or more heterologous nucleic acids comprising a nucleotide sequence encoding an OAC polypeptide, wherein the OAC polypeptide comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:21 or SEQ ID NO:48.

In some embodiments, a modified host cell of the disclosure comprises one or more heterologous nucleic acids comprising a nucleotide sequence encoding an OAC polypeptide, wherein the OAC polypeptide comprises the amino acid sequence set forth in SEQ ID NO:21. In some embodiments, a modified host cell of the disclosure comprises one or more heterologous nucleic acids comprising a nucleotide sequence encoding an OAC polypeptide, wherein the OAC polypeptide comprises the amino acid sequence set forth in SEQ ID NO:21, or a conservatively substituted amino acid sequence thereof. In some embodiments, a modified host cell of the disclosure comprises one or more heterologous nucleic acids comprising a nucleotide sequence encoding an OAC polypeptide, wherein the OAC polypeptide comprises an amino acid sequence having at least 50%, at least 55%, at least 60%, at least 65%, at least 70%, or at least 75% amino acid sequence identity to SEQ ID NO:21. In some embodiments, a modified host cell of the disclosure comprises one or more heterologous nucleic acids comprising a nucleotide sequence encoding an OAC polypeptide, wherein the OAC polypeptide comprises an amino acid sequence having at least 80%, at least 81%, at least 82%, at least 83%, or at least 84% amino acid sequence identity to SEQ ID NO:21. In some embodiments, a modified host cell of the disclosure comprises one or more heterologous nucleic acids comprising a nucleotide sequence encoding an OAC polypeptide, wherein the OAC polypeptide comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:21.

In some embodiments, a modified host cell of the disclosure comprises one or more heterologous nucleic acids comprising a nucleotide sequence encoding an OAC polypeptide, wherein the OAC polypeptide is a variant OAC (Y27F variant) polypeptide comprising the amino acid sequence set forth in SEQ ID NO:48. In some embodiments, a modified host cell of the disclosure comprises one or more heterologous nucleic acids comprising a nucleotide sequence encoding an OAC polypeptide, wherein the OAC polypeptide is a variant OAC (Y27F variant) polypeptide comprising the amino acid sequence set forth in SEQ ID NO:48, or a conservatively substituted amino acid sequence thereof. In some embodiments, a modified host cell of the disclosure comprises one or more heterologous nucleic acids comprising a nucleotide sequence encoding an OAC polypeptide, wherein the OAC polypeptide is a variant OAC (Y27F variant) polypeptide comprising an amino acid sequence having at least 50%, at least 55%, at least 60%, at least 65%, at least 70%, or at least 75% amino acid sequence identity to SEQ ID NO:48. In some embodiments, a modified host cell of the disclosure comprises one or more heterologous nucleic acids comprising a nucleotide sequence encoding an OAC polypeptide, wherein the OAC polypeptide is a variant OAC (Y27F variant) polypeptide comprising an amino acid sequence having at least 80%, at least 81%, at least 82%, at least 83%, or at least 84% amino acid sequence identity to SEQ ID NO:48. In some embodiments, a modified host cell of the disclosure comprises one or more heterologous nucleic acids comprising a nucleotide sequence encoding an OAC polypeptide, wherein the OAC polypeptide is a variant OAC (Y27F variant) polypeptide comprising an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:48.

Exemplary heterologous nucleic acids disclosed herein may include nucleic acids comprising a nucleotide sequence that encodes a TKS or OAC polypeptide, such as, a full-length TKS or OAC polypeptide, a fragment of a TKS or OAC polypeptide, a variant of a TKS or OAC polypeptide, a truncated TKS or OAC polypeptide, or a fusion polypeptide that has at least one activity of a TKS or OAC polypeptide. In some embodiments, the nucleotide sequence is codon-optimized.

In some embodiments, the TKS polypeptide is overexpressed in the modified host cell. Overexpression may be achieved by increasing the copy number of the one or more heterologous nucleic acids comprising a nucleotide sequence encoding the TKS polypeptide, e.g., through use of a high copy number expression vector (e.g., a plasmid that exists at 10-40 copies or about 100 copies per cell) and/or by operably linking the nucleotide sequence encoding the TKS polypeptide to a strong promoter. In some embodiments, the modified host cell has one copy of a heterologous nucleic acid comprising a nucleotide sequence encoding the TKS polypeptide. In some embodiments, the modified host cell has two copies of a heterologous nucleic acid comprising a nucleotide sequence encoding the TKS polypeptide. In some embodiments, the modified host cell has three copies of a heterologous nucleic acid comprising a nucleotide sequence encoding the TKS polypeptide. In some embodiments, the modified host cell has four copies of a heterologous nucleic acid comprising a nucleotide sequence encoding the TKS polypeptide. In some embodiments, the modified host cell has five copies of a heterologous nucleic acid comprising a nucleotide sequence encoding the TKS polypeptide. In some embodiments, the modified host cell has six copies of a heterologous nucleic acid comprising a nucleotide sequence encoding the TKS polypeptide. In some embodiments, the modified host cell has seven copies of a heterologous nucleic acid comprising a nucleotide sequence encoding the TKS polypeptide. In some embodiments, the modified host cell has eight copies of a heterologous nucleic acid comprising a nucleotide sequence encoding the TKS polypeptide. In some embodiments, the modified host cell has nine copies of a heterologous nucleic acid comprising a nucleotide sequence encoding the TKS polypeptide. In some embodiments, the modified host cell has ten copies of a heterologous nucleic acid comprising a nucleotide sequence encoding the TKS polypeptide. In some embodiments, the modified host cell has eleven copies of a heterologous nucleic acid comprising a nucleotide sequence encoding the TKS polypeptide. In some embodiments, the modified host cell has twelve copies of a heterologous nucleic acid comprising a nucleotide sequence encoding the TKS polypeptide. In some embodiments, the modified host cell has twelve or more copies of a heterologous nucleic acid comprising a nucleotide sequence encoding the TKS polypeptide. Increased copy number of the heterologous nucleic acid and/or codon optimization of the nucleotide sequence may result in an increase in the desired enzyme catalytic activity in the modified host cell.

In some embodiments, the OAC polypeptide is overexpressed in the modified host cell. Overexpression may be achieved by increasing the copy number of the one or more heterologous nucleic acids comprising a nucleotide sequence encoding the OAC polypeptide, e.g., through use of a high copy number expression vector (e.g., a plasmid that exists at 10-40 copies or about 100 copies per cell) and/or by operably linking the nucleotide sequence encoding the OAC polypeptide to a strong promoter. In some embodiments, the modified host cell has one copy of a heterologous nucleic acid comprising a nucleotide sequence encoding the OAC polypeptide. In some embodiments, the modified host cell has two copies of a heterologous nucleic acid comprising a nucleotide sequence encoding the OAC polypeptide. In some embodiments, the modified host cell has three copies of a heterologous nucleic acid comprising a nucleotide sequence encoding the OAC polypeptide. In some embodiments, the modified host cell has four copies of a heterologous nucleic acid comprising a nucleotide sequence encoding the OAC polypeptide. In some embodiments, the modified host cell has five copies of a heterologous nucleic acid comprising a nucleotide sequence encoding the OAC polypeptide. In some embodiments, the modified host cell has six copies of a heterologous nucleic acid comprising a nucleotide sequence encoding the OAC polypeptide. In some embodiments, the modified host cell has seven copies of a heterologous nucleic acid comprising a nucleotide sequence encoding the OAC polypeptide. In some embodiments, the modified host cell has eight copies of a heterologous nucleic acid comprising a nucleotide sequence encoding the OAC polypeptide. In some embodiments, the modified host cell has nine copies of a heterologous nucleic acid comprising a nucleotide sequence encoding the OAC polypeptide. In some embodiments, the modified host cell has ten copies of a heterologous nucleic acid comprising a nucleotide sequence encoding the OAC polypeptide. In some embodiments, the modified host cell has eleven copies of a heterologous nucleic acid comprising a nucleotide sequence encoding the OAC polypeptide. In some embodiments, the modified host cell has twelve copies of a heterologous nucleic acid comprising a nucleotide sequence encoding the OAC polypeptide. In some embodiments, the modified host cell has twelve or more copies of a heterologous nucleic acid comprising a nucleotide sequence encoding the OAC polypeptide. Increased copy number of the heterologous nucleic acid and/or codon optimization of the nucleotide sequence may result in an increase in the desired enzyme catalytic activity in the modified host cell.

In some embodiments, a modified host cell of the disclosure comprises one or more heterologous nucleic acids comprising a nucleotide sequence encoding a TKS polypeptide, wherein the nucleotide sequence is that set forth in SEQ ID NO:18. In some embodiments, a modified host cell of the disclosure comprises one or more heterologous nucleic acids comprising a nucleotide sequence encoding a TKS polypeptide, wherein the nucleotide sequence is that set forth in SEQ ID NO:18, or a codon degenerate nucleotide sequence thereof. In some embodiments, a modified host cell of the disclosure comprises one or more heterologous nucleic acids comprising a nucleotide sequence encoding a TKS polypeptide, wherein the nucleotide sequence has at least 80%, at least 81%, at least 82%, at least 83%, or at least 84% sequence identity to SEQ ID NO:18. In some embodiments, a modified host cell of the disclosure comprises one or more heterologous nucleic acids comprising a nucleotide sequence encoding a TKS polypeptide, wherein the nucleotide sequence has at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:18.

In some embodiments, a modified host cell of the disclosure comprises one or more heterologous nucleic acids comprising a nucleotide sequence encoding an OAC polypeptide, wherein the nucleotide sequence is that set forth in SEQ ID NO:20 or SEQ ID NO:47. In some embodiments, a modified host cell of the disclosure comprises one or more heterologous nucleic acids comprising a nucleotide sequence encoding an OAC polypeptide, wherein the nucleotide sequence is that set forth in SEQ ID NO:20 or SEQ ID NO:47, or a codon degenerate nucleotide sequence of any of the foregoing. In some embodiments, a modified host cell of the disclosure comprises one or more heterologous nucleic acids comprising a nucleotide sequence encoding an OAC polypeptide, wherein the nucleotide sequence has at least 80%, at least 81%, at least 82%, at least 83%, or at least 84% sequence identity to SEQ ID NO:20 or SEQ ID NO:47. In some embodiments, a modified host cell of the disclosure comprises one or more heterologous nucleic acids comprising a nucleotide sequence encoding an OAC polypeptide, wherein the nucleotide sequence has at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:20 or SEQ ID NO:47.

In some embodiments, a modified host cell of the disclosure comprises one or more heterologous nucleic acids comprising a nucleotide sequence encoding an OAC polypeptide, wherein the nucleotide sequence is that set forth in SEQ ID NO:20. In some embodiments, a modified host cell of the disclosure comprises one or more heterologous nucleic acids comprising a nucleotide sequence encoding an OAC polypeptide, wherein the nucleotide sequence is that set forth in SEQ ID NO:20, or a codon degenerate nucleotide sequence thereof. In some embodiments, a modified host cell of the disclosure comprises one or more heterologous nucleic acids comprising a nucleotide sequence encoding an OAC polypeptide, wherein the nucleotide sequence has at least 80%, at least 81%, at least 82%, at least 83%, or at least 84% sequence identity to SEQ ID NO:20. In some embodiments, a modified host cell of the disclosure comprises one or more heterologous nucleic acids comprising a nucleotide sequence encoding an OAC polypeptide, wherein the nucleotide sequence has at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:20.

In some embodiments, a modified host cell of the disclosure comprises one or more heterologous nucleic acids comprising a nucleotide sequence encoding an OAC polypeptide, wherein the OAC polypeptide is a variant OAC (Y27F variant) polypeptide, wherein the nucleotide sequence is that set forth in SEQ ID NO:47. In some embodiments, a modified host cell of the disclosure comprises one or more heterologous nucleic acids comprising a nucleotide sequence encoding an OAC polypeptide, wherein the OAC polypeptide is a variant OAC (Y27F variant) polypeptide, wherein the nucleotide sequence is that set forth in SEQ ID NO:47, or a codon degenerate nucleotide sequence thereof. In some embodiments, a modified host cell of the disclosure comprises one or more heterologous nucleic acids comprising a nucleotide sequence encoding an OAC polypeptide, wherein the OAC polypeptide is a variant OAC (Y27F variant) polypeptide, wherein the nucleotide sequence has at least 80%, at least 81%, at least 82%, at least 83%, or at least 84% sequence identity to SEQ ID NO:47. In some embodiments, a modified host cell of the disclosure comprises one or more heterologous nucleic acids comprising a nucleotide sequence encoding an OAC polypeptide, wherein the OAC polypeptide is a variant OAC (Y27F variant) polypeptide, wherein the nucleotide sequence has at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:47.

Polypeptides that Generate Geranyl Pyrophosphate

A modified host cell of the present disclosure may comprise one or more heterologous nucleic acids comprising a nucleotide sequence encoding a polypeptide that generates GPP. In some embodiments, the polypeptide that generates GPP is a geranyl pyrophosphate synthetase (GPPS) polypeptide. In some embodiments, the GPPS polypeptide also has farnesyl diphosphate synthase (FPPS) polypeptide activity. In some embodiments, the GPPS polypeptide is modified such that it has reduced FPPS polypeptide activity (e.g., at least 10%, at least 20%, at least 30%, at least 40%, at least 50%, at least 60%, at least 70%, at least 80%, at least 90%, or more than at least 90%, less FPPS polypeptide activity) than the corresponding wild-type or parental GPPS polypeptide from which the modified GPPS polypeptide is derived. In some embodiments, the GPPS polypeptide is modified such that it has substantially no FPPS polypeptide activity. In some embodiments, a modified host cell of the present disclosure comprises one or more heterologous nucleic acids comprising a nucleotide sequence encoding a GPPS polypeptide.

Exemplary GPPS polypeptides disclosed herein may include a full-length GPPS polypeptide, a fragment of a GPPS polypeptide, a variant of a GPPS polypeptide, a truncated GPPS polypeptide, or a fusion polypeptide that has at least one activity of a GPPS polypeptide.

In some embodiments, a modified host cell of the disclosure comprises one or more heterologous nucleic acids comprising a nucleotide sequence encoding a GPPS polypeptide, wherein the GPPS polypeptide is a variant GPPS (ERG20mut, F96W, N127W) polypeptide comprising the amino acid sequence set forth in SEQ ID NO:41. In some embodiments, a modified host cell of the disclosure comprises one or more heterologous nucleic acids comprising a nucleotide sequence encoding a GPPS polypeptide, wherein the GPPS polypeptide is a variant GPPS (ERG20mut, F96W, N127W) polypeptide comprising the amino acid sequence set forth in SEQ ID NO:41, or a conservatively substituted amino acid sequence thereof. In some embodiments, a modified host cell of the disclosure comprises one or more heterologous nucleic acids comprising a nucleotide sequence encoding a GPPS polypeptide, wherein the GPPS polypeptide is a variant GPPS (ERG20mut, F96W, N127W) polypeptide comprising an amino acid sequence having at least 50%, at least 55%, at least 60%, at least 65%, at least 70%, or at least 75% amino acid sequence identity to SEQ ID NO:41. In some embodiments, a modified host cell of the disclosure comprises one or more heterologous nucleic acids comprising a nucleotide sequence encoding a GPPS polypeptide, wherein the GPPS polypeptide is a variant GPPS (ERG20mut, F96W, N127W) polypeptide comprising an amino acid sequence having at least 80%, at least 81%, at least 82%, at least 83%, or at least 84% amino acid sequence identity to SEQ ID NO:41. In some embodiments, a modified host cell of the disclosure comprises one or more heterologous nucleic acids comprising a nucleotide sequence encoding a GPPS polypeptide, wherein the GPPS polypeptide is a variant GPPS (ERG20mut, F96W, N127W) polypeptide comprising an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:41. The mutation in this amino acid sequence shifts the ratio of GPP to farnesyl diphosphate (FPP), increasing the production of the GPP required to produce CBDA.

Exemplary heterologous nucleic acids disclosed herein may include nucleic acids comprising a nucleotide sequence that encodes a GPPS polypeptide, such as, a full-length GPPS polypeptide, a fragment of a GPPS polypeptide, a variant of a GPPS polypeptide, a truncated GPPS polypeptide, or a fusion polypeptide that has at least one activity of a GPPS polypeptide. In some embodiments, the nucleotide sequence is codon-optimized.

In some embodiments, the GPPS polypeptide is overexpressed in the modified host cell. Overexpression may be achieved by increasing the copy number of the one or more heterologous nucleic acids comprising a nucleotide sequence encoding the GPPS polypeptide, e.g., through use of a high copy number expression vector (e.g., a plasmid that exists at 10-40 copies or about 100 copies per cell) and/or by operably linking the nucleotide sequence encoding the GPPS polypeptide to a strong promoter. In some embodiments, the modified host cell has one copy of a heterologous nucleic acid comprising a nucleotide sequence encoding the GPPS polypeptide. In some embodiments, the modified host cell has two copies of a heterologous nucleic acid comprising a nucleotide sequence encoding the GPPS polypeptide. In some embodiments, the modified host cell has three copies of a heterologous nucleic acid comprising a nucleotide sequence encoding the GPPS polypeptide. In some embodiments, the modified host cell has four copies of a heterologous nucleic acid comprising a nucleotide sequence encoding the GPPS polypeptide. In some embodiments, the modified host cell has five copies of a heterologous nucleic acid comprising a nucleotide sequence encoding the GPPS polypeptide. In some embodiments, the modified host cell has six copies of a heterologous nucleic acid comprising a nucleotide sequence encoding the GPPS polypeptide. In some embodiments, the modified host cell has seven copies of a heterologous nucleic acid comprising a nucleotide sequence encoding the GPPS polypeptide. In some embodiments, the modified host cell has eight copies of a heterologous nucleic acid comprising a nucleotide sequence encoding the GPPS polypeptide. In some embodiments, the modified host cell has eight or more copies of a heterologous nucleic acid comprising a nucleotide sequence encoding the GPPS polypeptide. Increased copy number of the heterologous nucleic acid and/or codon optimization of the nucleotide sequence may result in an increase in the desired enzyme catalytic activity in the modified host cell.

In some embodiments, a modified host cell of the disclosure comprises one or more heterologous nucleic acids comprising a nucleotide sequence encoding a GPPS polypeptide, wherein the GPPS polypeptide is a variant GPPS (ERG20mut, F96W, N127W) polypeptide, wherein the nucleotide sequence is that set forth in SEQ ID NO:40. In some embodiments, a modified host cell of the disclosure comprises one or more heterologous nucleic acids comprising a nucleotide sequence encoding a GPPS polypeptide, wherein the GPPS polypeptide is a variant GPPS (ERG20mut, F96W, N127W) polypeptide, wherein the nucleotide sequence is that set forth in SEQ ID NO:40, or a codon degenerate nucleotide sequence thereof. In some embodiments, a modified host cell of the disclosure comprises one or more heterologous nucleic acids comprising a nucleotide sequence encoding a GPPS polypeptide, wherein the GPPS polypeptide is a variant GPPS (ERG20mut, F96W, N127W) polypeptide, wherein the nucleotide sequence has at least 80%, at least 81%, at least 82%, at least 83%, or at least 84% sequence identity to SEQ ID NO:40. In some embodiments, a modified host cell of the disclosure comprises one or more heterologous nucleic acids comprising a nucleotide sequence encoding a GPPS polypeptide, wherein the GPPS polypeptide is a variant GPPS (ERG20mut, F96W, N127W) polypeptide, wherein the nucleotide sequence has at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:40.

Polypeptides that Generate Acetyl-CoA from Pyruvate

A modified host cell of the present disclosure may comprise one or more heterologous nucleic acids comprising a nucleotide sequence encoding a polypeptide that generates acetyl-CoA from pyruvate. Polypeptides that generate acetyl-CoA from pyruvate may include a pyruvate decarboxylase (PDC) polypeptide. In some embodiments, a modified host cell of the present disclosure comprises one or more heterologous nucleic acids comprising a nucleotide sequence encoding a PDC polypeptide.

Exemplary PDC polypeptides disclosed herein may include a full-length PDC polypeptide, a fragment of a PDC polypeptide, a variant of a PDC polypeptide, a truncated PDC polypeptide, or a fusion polypeptide that has at least one activity of a PDC polypeptide.

In some embodiments, a modified host cell of the disclosure comprises one or more heterologous nucleic acids comprising a nucleotide sequence encoding a PDC polypeptide, wherein the PDC polypeptide comprises the amino acid sequence set forth in SEQ ID NO:35. In some embodiments, a modified host cell of the disclosure comprises one or more heterologous nucleic acids comprising a nucleotide sequence encoding a PDC polypeptide, wherein the PDC polypeptide comprises the amino acid sequence set forth in SEQ ID NO:35, or a conservatively substituted amino acid sequence thereof. In some embodiments, a modified host cell of the disclosure comprises one or more heterologous nucleic acids comprising a nucleotide sequence encoding a PDC polypeptide, wherein the PDC polypeptide comprises an amino acid sequence having at least 50%, at least 55%, at least 60%, at least 65%, at least 70%, or at least 75% amino acid sequence identity to SEQ ID NO:35. In some embodiments, a modified host cell of the disclosure comprises one or more heterologous nucleic acids comprising a nucleotide sequence encoding a PDC polypeptide, wherein the PDC polypeptide comprises an amino acid sequence having at least 80%, at least 81%, at least 82%, at least 83%, or at least 84% amino acid sequence identity to SEQ ID NO:35. In some embodiments, a modified host cell of the disclosure comprises one or more heterologous nucleic acids comprising a nucleotide sequence encoding a PDC polypeptide, wherein the PDC polypeptide comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:35.

Exemplary heterologous nucleic acids disclosed herein may include nucleic acids comprising a nucleotide sequence that encodes a PDC polypeptide, such as, a full-length PDC polypeptide, a fragment of a PDC polypeptide, a variant of a PDC polypeptide, a truncated PDC polypeptide, or a fusion polypeptide that has at least one activity of a PDC polypeptide. In some embodiments, the nucleotide sequence is codon-optimized.

In some embodiments, the PDC polypeptide is overexpressed in the modified host cell. Overexpression may be achieved by increasing the copy number of the one or more heterologous nucleic acids comprising a nucleotide sequence encoding the PDC polypeptide, e.g., through use of a high copy number expression vector (e.g., a plasmid that exists at 10-40 copies or about 100 copies per cell) and/or by operably linking the nucleotide sequence encoding the PDC polypeptide to a strong promoter. In some embodiments, the modified host cell has one copy of a heterologous nucleic acid comprising a nucleotide sequence encoding the PDC polypeptide. In some embodiments, the modified host cell has two copies of a heterologous nucleic acid comprising a nucleotide sequence encoding the PDC polypeptide. In some embodiments, the modified host cell has three copies of a heterologous nucleic acid comprising a nucleotide sequence encoding the PDC polypeptide. In some embodiments, the modified host cell has four copies of a heterologous nucleic acid comprising a nucleotide sequence encoding the PDC polypeptide. In some embodiments, the modified host cell has five copies of a heterologous nucleic acid comprising a nucleotide sequence encoding the PDC polypeptide. In some embodiments, the modified host cell has five or more copies of a heterologous nucleic acid comprising a nucleotide sequence encoding the PDC polypeptide. Increased copy number of the heterologous nucleic acid and/or codon optimization of the nucleotide sequence may result in an increase in the desired enzyme catalytic activity in the modified host cell.

In some embodiments, a modified host cell of the disclosure comprises one or more heterologous nucleic acids comprising a nucleotide sequence encoding a PDC polypeptide, wherein the nucleotide sequence is that set forth in SEQ ID NO:34. In some embodiments, a modified host cell of the disclosure comprises one or more heterologous nucleic acids comprising a nucleotide sequence encoding a PDC polypeptide, wherein the nucleotide sequence is that set forth in SEQ ID NO:34, or a codon degenerate nucleotide sequence thereof. In some embodiments, a modified host cell of the disclosure comprises one or more heterologous nucleic acids comprising a nucleotide sequence encoding a PDC polypeptide, wherein the nucleotide sequence has at least 80%, at least 81%, at least 82%, at least 83%, or at least 84% sequence identity to SEQ ID NO:34. In some embodiments, a modified host cell of the disclosure comprises one or more heterologous nucleic acids comprising a nucleotide sequence encoding a PDC polypeptide, wherein the nucleotide sequence has at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:34.

Polypeptides that Condense Two Molecules of Acetyl-CoA to Generate Acetoacetyl-CoA A modified host cell of the disclosure may comprise one or more heterologous nucleic acids comprising a nucleotide sequence encoding a polypeptide that condenses two molecules of acetyl-CoA to generate acetoacetyl-CoA. In some embodiments, the polypeptide that condenses two molecules of acetyl-CoA to generate acetoacetyl-CoA is an acetoacetyl-CoA thiolase polypeptide. In some embodiments, a modified host cell of the present disclosure comprises one or more heterologous nucleic acids comprising a nucleotide sequence encoding an acetoacetyl-CoA thiolase polypeptide.

Exemplary acetoacetyl-CoA thiolase polypeptides disclosed herein may include a full-length acetoacetyl-CoA thiolase polypeptide, a fragment of an acetoacetyl-CoA thiolase polypeptide, a variant of an acetoacetyl-CoA thiolase polypeptide, a truncated acetoacetyl-CoA thiolase polypeptide, or a fusion polypeptide that has at least one activity of an acetoacetyl-CoA thiolase polypeptide.

In some embodiments, a modified host cell of the disclosure comprises one or more heterologous nucleic acids comprising a nucleotide sequence encoding an acetoacetyl-CoA thiolase polypeptide, wherein the acetoacetyl-CoA thiolase polypeptide comprises the amino acid sequence set forth in SEQ ID NO:31. In some embodiments, a modified host cell of the disclosure comprises one or more heterologous nucleic acids comprising a nucleotide sequence encoding an acetoacetyl-CoA thiolase polypeptide, wherein the acetoacetyl-CoA thiolase polypeptide comprises the amino acid sequence set forth in SEQ ID NO:31, or a conservatively substituted amino acid sequence thereof. In some embodiments, a modified host cell of the disclosure comprises one or more heterologous nucleic acids comprising a nucleotide sequence encoding an acetoacetyl-CoA thiolase polypeptide, wherein the acetoacetyl-CoA thiolase polypeptide comprises an amino acid sequence having at least 50%, at least 55%, at least 60%, at least 65%, at least 70%, or at least 75% amino acid sequence identity to SEQ ID NO:31. In some embodiments, a modified host cell of the disclosure comprises one or more heterologous nucleic acids comprising a nucleotide sequence encoding an acetoacetyl-CoA thiolase polypeptide, wherein the acetoacetyl-CoA thiolase polypeptide comprises an amino acid sequence having at least 80%, at least 81%, at least 82%, at least 83%, or at least 84% amino acid sequence identity to SEQ ID NO:31. In some embodiments, a modified host cell of the disclosure comprises one or more heterologous nucleic acids comprising a nucleotide sequence encoding an acetoacetyl-CoA thiolase polypeptide, wherein the acetoacetyl-CoA thiolase polypeptide comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:31.

Exemplary heterologous nucleic acids disclosed herein may include nucleic acids comprising a nucleotide sequence that encodes an acetoacetyl-CoA thiolase polypeptide, such as, a full-length acetoacetyl-CoA thiolase polypeptide, a fragment of an acetoacetyl-CoA thiolase polypeptide, a variant of an acetoacetyl-CoA thiolase polypeptide, a truncated acetoacetyl-CoA thiolase polypeptide, or a fusion polypeptide that has at least one activity of an acetoacetyl-CoA thiolase polypeptide. In some embodiments, the nucleotide sequence is codon-optimized.

In some embodiments, the acetoacetyl-CoA thiolase polypeptide is overexpressed in the modified host cell. Overexpression may be achieved by increasing the copy number of the one or more heterologous nucleic acids comprising a nucleotide sequence encoding the acetoacetyl-CoA thiolase polypeptide, e.g., through use of a high copy number expression vector (e.g., a plasmid that exists at 10-40 copies or about 100 copies per cell) and/or by operably linking the nucleotide sequence encoding the acetoacetyl-CoA thiolase polypeptide to a strong promoter. In some embodiments, the modified host cell has one copy of a heterologous nucleic acid comprising a nucleotide sequence encoding the acetoacetyl-CoA thiolase polypeptide. In some embodiments, the modified host cell has two copies of a heterologous nucleic acid comprising a nucleotide sequence encoding the acetoacetyl-CoA thiolase polypeptide. In some embodiments, the modified host cell has three copies of a heterologous nucleic acid comprising a nucleotide sequence encoding the acetoacetyl-CoA thiolase polypeptide. In some embodiments, the modified host cell has four copies of a heterologous nucleic acid comprising a nucleotide sequence encoding the acetoacetyl-CoA thiolase polypeptide. In some embodiments, the modified host cell has five copies of a heterologous nucleic acid comprising a nucleotide sequence encoding the acetoacetyl-CoA thiolase polypeptide. In some embodiments, the modified host cell has five or more copies of a heterologous nucleic acid comprising a nucleotide sequence encoding the acetoacetyl-CoA thiolase polypeptide. Increased copy number of the heterologous nucleic acid and/or codon optimization of the nucleotide sequence may result in an increase in the desired enzyme catalytic activity in the modified host cell.

In some embodiments, a modified host cell of the disclosure comprises one or more heterologous nucleic acids comprising a nucleotide sequence encoding an acetoacetyl-CoA thiolase polypeptide, wherein the nucleotide sequence is that set forth in SEQ ID NO:30. In some embodiments, a modified host cell of the disclosure comprises one or more heterologous nucleic acids comprising a nucleotide sequence encoding an acetoacetyl-CoA thiolase polypeptide, wherein the nucleotide sequence is that set forth in SEQ ID NO:30, or a codon degenerate nucleotide sequence thereof. In some embodiments, a modified host cell of the disclosure comprises one or more heterologous nucleic acids comprising a nucleotide sequence encoding an acetoacetyl-CoA thiolase polypeptide, wherein the nucleotide sequence has at least 80%, at least 81%, at least 82%, at least 83%, or at least 84% sequence identity to SEQ ID NO:30. In some embodiments, a modified host cell of the disclosure comprises one or more heterologous nucleic acids comprising a nucleotide sequence encoding an acetoacetyl-CoA thiolase polypeptide, wherein the nucleotide sequence has at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:30.

Mevalonate Pathway Polypeptides

A modified host cell of the present disclosure may comprise one or more heterologous nucleic acids comprising nucleotide sequences encoding one or more polypeptides having at least one activity of a polypeptide present in the mevalonate (MEV) pathway. In certain such embodiments, the one or more polypeptides having at least one activity of a polypeptide present in the mevalonate (MEV) pathway comprise one or more MEV pathway polypeptides.

In some embodiments, the one or more polypeptides that are part of a biosynthetic pathway that generates GPP are one or more polypeptides having at least one activity of a polypeptide present in the mevalonate pathway. The mevalonate pathway may comprise polypeptides that catalyze the following steps: (a) condensing two molecules of acetyl-CoA to generate acetoacetyl-CoA (e.g., by action of an acetoacetyl-CoA thiolase polypeptide); (b) condensing acetoacetyl-CoA with acetyl-CoA to form hydroxymethylglutaryl-CoA (HMG-CoA) (e.g., by action of a HMGS polypeptide); (c) converting HMG-CoA to mevalonate (e.g., by action of an HMGR polypeptide); (d) phosphorylating mevalonate to mevalonate 5-phosphate (e.g., by action of a MK polypeptide); (e) converting mevalonate 5-phosphate to mevalonate 5-pyrophosphate (e.g., by action of a PMK polypeptide); (f) converting mevalonate 5-pyrophosphate to isopentenyl pyrophosphate (e.g., by action of a mevalonate pyrophosphate decarboxylase (MPD or MVD1) polypeptide); and (g) converting isopentenyl pyrophosphate to dimethylallyl pyrophosphate (e.g., by action of an isopentenyl pyrophosphate isomerase (IDI1) polypeptide).

In some embodiments, a modified host cell of the present disclosure comprises one or more heterologous nucleic acids comprising nucleotide sequences encoding a MEV pathway polypeptide. In some embodiments, a modified host cell of the present disclosure comprises one or more heterologous nucleic acids comprising nucleotide sequences encoding one or more MEV pathway polypeptide. In some embodiments, a modified host cell of the present disclosure comprises one or more heterologous nucleic acids comprising nucleotide sequences encoding two or more MEV pathway polypeptides. In some embodiments, a modified host cell of the present disclosure comprises one or more heterologous nucleic acids comprising nucleotide sequences encoding three or more MEV pathway polypeptides. In some embodiments, a modified host cell of the present disclosure comprises one or more heterologous nucleic acids comprising nucleotide sequences encoding four or more MEV pathway polypeptides. In some embodiments, a modified host cell of the present disclosure comprises one or more heterologous nucleic acids comprising nucleotide sequences encoding five or more MEV pathway polypeptides. In some embodiments, a modified host cell of the present disclosure comprises one or more heterologous nucleic acids comprising nucleotide sequences encoding six or more MEV pathway polypeptides. In some embodiments, a modified host cell of the present disclosure comprises one or more heterologous nucleic acids comprising nucleotide sequences encoding all MEV pathway polypeptides.

Exemplary MEV pathway polypeptides disclosed herein may include a full-length MEV pathway polypeptide, a fragment of a MEV pathway polypeptide, a variant of a MEV pathway polypeptide, a truncated MEV pathway polypeptide, or a fusion polypeptide that has at least one activity of a MEV pathway polypeptide. In some embodiments, the one or more MEV pathway polypeptides are selected from the group consisting of an acetoacetyl-CoA thiolase polypeptide, a HMGS polypeptide, a HMGR polypeptide, an MK polypeptide, a PMK polypeptide, an MVD1 polypeptide, and an IDI1 polypeptide.

In some embodiments, a modified host cell of the disclosure comprises one or more heterologous nucleic acids comprising a nucleotide sequence encoding a HMGS polypeptide, wherein the HMGS polypeptide comprises the amino acid sequence set forth in SEQ ID NO:29. In some embodiments, a modified host cell of the disclosure comprises one or more heterologous nucleic acids comprising a nucleotide sequence encoding a HMGS polypeptide, wherein the HMGS polypeptide comprises the amino acid sequence set forth in SEQ ID NO:29, or a conservatively substituted amino acid sequence thereof. In some embodiments, a modified host cell of the disclosure comprises one or more heterologous nucleic acids comprising a nucleotide sequence encoding a HMGS polypeptide, wherein the HMGS polypeptide comprises an amino acid sequence having at least 50%, at least 55%, at least 60%, at least 65%, at least 70%, or at least 75% amino acid sequence identity to SEQ ID NO:29. In some embodiments, a modified host cell of the disclosure comprises one or more heterologous nucleic acids comprising a nucleotide sequence encoding a HMGS polypeptide, wherein the HMGS polypeptide comprises an amino acid sequence having at least 80%, at least 81%, at least 82%, at least 83%, or at least 84% amino acid sequence identity to SEQ ID NO:29. In some embodiments, a modified host cell of the disclosure comprises one or more heterologous nucleic acids comprising a nucleotide sequence encoding a HMGS polypeptide, wherein the HMGS polypeptide comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:29.

In some embodiments, the HMGR polypeptide is a truncated HMGR (tHMGR) polypeptide. In some embodiments, a modified host cell of the disclosure comprises one or more heterologous nucleic acids comprising a nucleotide sequence encoding a tHMGR polypeptide, wherein the tHMGR polypeptide comprises the amino acid sequence set forth in SEQ ID NO:27. In some embodiments, a modified host cell of the disclosure comprises one or more heterologous nucleic acids comprising a nucleotide sequence encoding a tHMGR polypeptide, wherein the tHMGR polypeptide comprises the amino acid sequence set forth in SEQ ID NO:27, or a conservatively substituted amino acid sequence thereof. In some embodiments, a modified host cell of the disclosure comprises one or more heterologous nucleic acids comprising a nucleotide sequence encoding a tHMGR polypeptide, wherein the tHMGR polypeptide comprises an amino acid sequence having at least 50%, at least 55%, at least 60%, at least 65%, at least 70%, or at least 75% amino acid sequence identity to SEQ ID NO:27. In some embodiments, a modified host cell of the disclosure comprises one or more heterologous nucleic acids comprising a nucleotide sequence encoding a tHMGR polypeptide, wherein the tHMGR polypeptide comprises an amino acid sequence having at least 80%, at least 81%, at least 82%, at least 83%, or at least 84% amino acid sequence identity to SEQ ID NO:27. In some embodiments, a modified host cell of the disclosure comprises one or more heterologous nucleic acids comprising a nucleotide sequence encoding a tHMGR polypeptide, wherein the tHMGR polypeptide comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:27.

In some embodiments, a modified host cell of the disclosure comprises one or more heterologous nucleic acids comprising a nucleotide sequence encoding a MK polypeptide, wherein the MK polypeptide comprises the amino acid sequence set forth in SEQ ID NO:39. In some embodiments, a modified host cell of the disclosure comprises one or more heterologous nucleic acids comprising a nucleotide sequence encoding a MK polypeptide, wherein the MK polypeptide comprises the amino acid sequence set forth in SEQ ID NO:39, or a conservatively substituted amino acid sequence thereof. In some embodiments, a modified host cell of the disclosure comprises one or more heterologous nucleic acids comprising a nucleotide sequence encoding a MK polypeptide, wherein the MK polypeptide comprises an amino acid sequence having at least 50%, at least 55%, at least 60%, at least 65%, at least 70%, or at least 75% amino acid sequence identity to SEQ ID NO:39. In some embodiments, a modified host cell of the disclosure comprises one or more heterologous nucleic acids comprising a nucleotide sequence encoding a MK polypeptide, wherein the MK polypeptide comprises an amino acid sequence having at least 80%, at least 81%, at least 82%, at least 83%, or at least 84% amino acid sequence identity to SEQ ID NO:39. In some embodiments, a modified host cell of the disclosure comprises one or more heterologous nucleic acids comprising a nucleotide sequence encoding a MK polypeptide, wherein the MK polypeptide comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:39.

In some embodiments, a modified host cell of the disclosure comprises one or more heterologous nucleic acids comprising a nucleotide sequence encoding a PMK polypeptide, wherein the PMK polypeptide comprises the amino acid sequence set forth in SEQ ID NO:37. In some embodiments, a modified host cell of the disclosure comprises one or more heterologous nucleic acids comprising a nucleotide sequence encoding a PMK polypeptide, wherein the PMK polypeptide comprises the amino acid sequence set forth in SEQ ID NO:37, or a conservatively substituted amino acid sequence thereof. In some embodiments, a modified host cell of the disclosure comprises one or more heterologous nucleic acids comprising a nucleotide sequence encoding a PMK polypeptide, wherein the PMK polypeptide comprises an amino acid sequence having at least 50%, at least 55%, at least 60%, at least 65%, at least 70%, or at least 75% amino acid sequence identity to SEQ ID NO:37. In some embodiments, a modified host cell of the disclosure comprises one or more heterologous nucleic acids comprising a nucleotide sequence encoding a PMK polypeptide, wherein the PMK polypeptide comprises an amino acid sequence having at least 80%, at least 81%, at least 82%, at least 83%, or at least 84% amino acid sequence identity to SEQ ID NO:37. In some embodiments, a modified host cell of the disclosure comprises one or more heterologous nucleic acids comprising a nucleotide sequence encoding a PMK polypeptide, wherein the PMK polypeptide comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:37.

In some embodiments, a modified host cell of the disclosure comprises one or more heterologous nucleic acids comprising a nucleotide sequence encoding a MVD1 polypeptide, wherein the MVD1 polypeptide comprises the amino acid sequence set forth in SEQ ID NO:33. In some embodiments, a modified host cell of the disclosure comprises one or more heterologous nucleic acids comprising a nucleotide sequence encoding a MVD1 polypeptide, wherein the MVD1 polypeptide comprises the amino acid sequence set forth in SEQ ID NO:33, or a conservatively substituted amino acid sequence thereof. In some embodiments, a modified host cell of the disclosure comprises one or more heterologous nucleic acids comprising a nucleotide sequence encoding a MVD1 polypeptide, wherein the MVD1 polypeptide comprises an amino acid sequence having at least 50%, at least 55%, at least 60%, at least 65%, at least 70%, or at least 75% amino acid sequence identity to SEQ ID NO:33. In some embodiments, a modified host cell of the disclosure comprises one or more heterologous nucleic acids comprising a nucleotide sequence encoding a MVD1 polypeptide, wherein the MVD1 polypeptide comprises an amino acid sequence having at least 80%, at least 81%, at least 82%, at least 83%, or at least 84% amino acid sequence identity to SEQ ID NO:33. In some embodiments, a modified host cell of the disclosure comprises one or more heterologous nucleic acids comprising a nucleotide sequence encoding a MVD1 polypeptide, wherein the MVD1 polypeptide comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:33.

In some embodiments, a modified host cell of the disclosure comprises one or more heterologous nucleic acids comprising a nucleotide sequence encoding an IDI1 polypeptide, wherein the IDI1 polypeptide comprises the amino acid sequence set forth in SEQ ID NO:25. In some embodiments, a modified host cell of the disclosure comprises one or more heterologous nucleic acids comprising a nucleotide sequence encoding an IDI1 polypeptide, wherein the IDI1 polypeptide comprises the amino acid sequence set forth in SEQ ID NO:25, or a conservatively substituted amino acid sequence thereof. In some embodiments, a modified host cell of the disclosure comprises one or more heterologous nucleic acids comprising a nucleotide sequence encoding an IDI1 polypeptide, wherein the IDI1 polypeptide comprises an amino acid sequence having at least 50%, at least 55%, at least 60%, at least 65%, at least 70%, or at least 75% amino acid sequence identity to SEQ ID NO:25. In some embodiments, a modified host cell of the disclosure comprises one or more heterologous nucleic acids comprising a nucleotide sequence encoding an IDI1 polypeptide, wherein the IDI1 polypeptide comprises an amino acid sequence having at least 80%, at least 81%, at least 82%, at least 83%, or at least 84% amino acid sequence identity to SEQ ID NO:25. In some embodiments, a modified host cell of the disclosure comprises one or more heterologous nucleic acids comprising a nucleotide sequence encoding an IDI1 polypeptide, wherein the IDI1 polypeptide comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:25.

Exemplary heterologous nucleic acids disclosed herein may include nucleic acids comprising a nucleotide sequence that encodes a MEV pathway polypeptide, such as, a full-length MEV pathway polypeptide, a fragment of a MEV pathway polypeptide, a variant of a MEV pathway polypeptide, a truncated MEV pathway polypeptide, or a fusion polypeptide that has at least one activity of a polypeptide that is part of the MEV pathway. In some embodiments, the nucleotide sequence is codon-optimized.

In some embodiments, one or more MEV pathway polypeptides are overexpressed in the modified host cell. Overexpression may be achieved by increasing the copy number of the one or more heterologous nucleic acids comprising nucleotide sequences encoding a MEV pathway polypeptide, e.g., through use of a high copy number expression vector (e.g., a plasmid that exists at 10-40 copies or about 100 copies per cell) and/or by operably linking the nucleotide sequences encoding a MEV pathway polypeptide to a strong promoter. In some embodiments, the modified host cell has one copy of a heterologous nucleic acid comprising a nucleotide sequence encoding a MEV pathway polypeptide. In some embodiments, the modified host cell has two copies of a heterologous nucleic acid comprising a nucleotide sequence encoding a MEV pathway polypeptide. In some embodiments, the modified host cell has three copies of a heterologous nucleic acid comprising a nucleotide sequence encoding a MEV pathway polypeptide. In some embodiments, the modified host cell has four copies of a heterologous nucleic acid comprising a nucleotide sequence encoding a MEV pathway polypeptide. In some embodiments, the modified host cell has five copies of a heterologous nucleic acid comprising a nucleotide sequence encoding a MEV pathway polypeptide. In some embodiments, the modified host cell has five or more copies of a heterologous nucleic acid comprising a nucleotide sequence encoding a MEV pathway polypeptide. Increased copy number of the heterologous nucleic acid and/or codon optimization of the nucleotide sequence may result in an increase in the desired enzyme catalytic activity in the modified host cell.

In some embodiments, a modified host cell of the disclosure comprises one or more heterologous nucleic acids comprising a nucleotide sequence encoding a HMGS polypeptide, wherein the nucleotide sequence is that set forth in SEQ ID NO:28. In some embodiments, a modified host cell of the disclosure comprises one or more heterologous nucleic acids comprising a nucleotide sequence encoding a HMGS polypeptide, wherein the nucleotide sequence is that set forth in SEQ ID NO:28, or a codon degenerate nucleotide sequence thereof. In some embodiments, a modified host cell of the disclosure comprises one or more heterologous nucleic acids comprising a nucleotide sequence encoding a HMGS polypeptide, wherein the nucleotide sequence has at least 80%, at least 81%, at least 82%, at least 83%, or at least 84% sequence identity to SEQ ID NO:28. In some embodiments, a modified host cell of the disclosure comprises one or more heterologous nucleic acids comprising a nucleotide sequence encoding a HMGS polypeptide, wherein the nucleotide sequence has at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:28.

In some embodiments, a modified host cell of the disclosure comprises one or more heterologous nucleic acids comprising a nucleotide sequence encoding a tHMGR polypeptide, wherein the nucleotide sequence is that set forth in SEQ ID NO:26. In some embodiments, a modified host cell of the disclosure comprises one or more heterologous nucleic acids comprising a nucleotide sequence encoding a tHMGR polypeptide, wherein the nucleotide sequence is that set forth in SEQ ID NO:26, or a codon degenerate nucleotide sequence thereof. In some embodiments, a modified host cell of the disclosure comprises one or more heterologous nucleic acids comprising a nucleotide sequence encoding a tHMGR polypeptide, wherein the nucleotide sequence has at least 80%, at least 81%, at least 82%, at least 83%, or at least 84% sequence identity to SEQ ID NO:26. In some embodiments, a modified host cell of the disclosure comprises one or more heterologous nucleic acids comprising a nucleotide sequence encoding a tHMGR polypeptide, wherein the nucleotide sequence has at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:26.

In some embodiments, a modified host cell of the present disclosure comprises two or more heterologous nucleic acids comprising a nucleotide sequence that encodes a tHMGR polypeptide. In some embodiments, a modified host cell of the present disclosure comprises two heterologous nucleic acids comprising a nucleotide sequence that encodes a tHMGR polypeptide.

In some embodiments, a modified host cell of the disclosure comprises one or more heterologous nucleic acids comprising a nucleotide sequence encoding a MK polypeptide, wherein the nucleotide sequence is that set forth in SEQ ID NO:38. In some embodiments, a modified host cell of the disclosure comprises one or more heterologous nucleic acids comprising a nucleotide sequence encoding a MK polypeptide, wherein the nucleotide sequence is that set forth in SEQ ID NO:38, or a codon degenerate nucleotide sequence thereof. In some embodiments, a modified host cell of the disclosure comprises one or more heterologous nucleic acids comprising a nucleotide sequence encoding a MK polypeptide, wherein the nucleotide sequence has at least 80%, at least 81%, at least 82%, at least 83%, or at least 84% sequence identity to SEQ ID NO:38. In some embodiments, a modified host cell of the disclosure comprises one or more heterologous nucleic acids comprising a nucleotide sequence encoding a MK polypeptide, wherein the nucleotide sequence has at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:38.

In some embodiments, a modified host cell of the disclosure comprises one or more heterologous nucleic acids comprising a nucleotide sequence encoding a PMK polypeptide, wherein the nucleotide sequence is that set forth in SEQ ID NO:36. In some embodiments, a modified host cell of the disclosure comprises one or more heterologous nucleic acids comprising a nucleotide sequence encoding a PMK polypeptide, wherein the nucleotide sequence is that set forth in SEQ ID NO:36, or a codon degenerate nucleotide sequence thereof. In some embodiments, a modified host cell of the disclosure comprises one or more heterologous nucleic acids comprising a nucleotide sequence encoding a PMK polypeptide, wherein the nucleotide sequence has at least 80%, at least 81%, at least 82%, at least 83%, or at least 84% sequence identity to SEQ ID NO:36. In some embodiments, a modified host cell of the disclosure comprises one or more heterologous nucleic acids comprising a nucleotide sequence encoding a PMK polypeptide, wherein the nucleotide sequence has at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:36.

In some embodiments, a modified host cell of the disclosure comprises one or more heterologous nucleic acids comprising a nucleotide sequence encoding a MVD1 polypeptide, wherein the nucleotide sequence is that set forth in SEQ ID NO:32. In some embodiments, a modified host cell of the disclosure comprises one or more heterologous nucleic acids comprising a nucleotide sequence encoding a MVD1 polypeptide, wherein the nucleotide sequence is that set forth in SEQ ID NO:32, or a codon degenerate nucleotide sequence thereof. In some embodiments, a modified host cell of the disclosure comprises one or more heterologous nucleic acids comprising a nucleotide sequence encoding a MVD1 polypeptide, wherein the nucleotide sequence has at least 80%, at least 81%, at least 82%, at least 83%, or at least 84% sequence identity to SEQ ID NO:32. In some embodiments, a modified host cell of the disclosure comprises one or more heterologous nucleic acids comprising a nucleotide sequence encoding a MVD1 polypeptide, wherein the nucleotide sequence has at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:32.

In some embodiments, a modified host cell of the disclosure comprises one or more heterologous nucleic acids comprising a nucleotide sequence encoding an IDI1 polypeptide, wherein the nucleotide sequence is that set forth in SEQ ID NO:24. In some embodiments, a modified host cell of the disclosure comprises one or more heterologous nucleic acids comprising a nucleotide sequence encoding an IDI1 polypeptide, wherein the nucleotide sequence is that set forth in SEQ ID NO:24, or a codon degenerate nucleotide sequence thereof. In some embodiments, a modified host cell of the disclosure comprises one or more heterologous nucleic acids comprising a nucleotide sequence encoding an IDI1 polypeptide, wherein the nucleotide sequence has at least 80%, at least 81%, at least 82%, at least 83%, or at least 84% sequence identity to SEQ ID NO:24. In some embodiments, a modified host cell of the disclosure comprises one or more heterologous nucleic acids comprising a nucleotide sequence encoding an IDI1 polypeptide, wherein the nucleotide sequence has at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:24.

Modified Host Cells to Produce Cannabinoids or Cannabinoid Derivatives and/or Express Engineered Variants of the Disclosure The present disclosure provides modified host cells comprising one or more nucleic acids comprising a nucleotide sequence encoding an engineered variant of the disclosure. The modified host cells of the disclosure comprising one or more nucleic acids comprising a nucleotide sequence encoding an engineered variant of the disclosure may be for producing cannabinoids or cannabinoid derivatives and/or for expressing an engineered variant of the disclosure. In some embodiments, the nucleotide sequence encoding an engineered variant of the disclosure is codon-optimized. In some embodiments, the nucleotide sequences encoding the one or more of a KAR2 polypeptide, a PDI1 polypeptide, an ERO1 polypeptide, a FAD1 polypeptide, or an IRE1 polypeptide, and/or one or more polypeptides involved in cannabinoid or cannabinoid precursor (e.g., geranylpyrophosphate (GPP), prenyl phosphates, olivetolic acid, or hexanoyl-CoA) biosynthesis are codon-optimized.

The disclosure provides for modified host cells for producing cannabinoids or cannabinoid derivatives. For producing cannabinoids or cannabinoid derivatives, modified host cells disclosed herein may be modified to express or overexpress one or more nucleic acids disclosed herein comprising nucleotide sequences encoding an engineered variant of the disclosure, one or more of a KAR2 polypeptide, a PDI1 polypeptide, an ERO1 polypeptide, a FAD1 polypeptide, or an IRE1 polypeptide, and/or one or more polypeptides involved in cannabinoid or cannabinoid precursor (e.g., geranylpyrophosphate (GPP), prenyl phosphates, olivetolic acid, or hexanoyl-CoA) biosynthesis. A modified host cell for producing cannabinoids or cannabinoid derivatives may comprise a deletion or downregulation of one or more genes encoding one or more of a ROT2 polypeptide or a PEP4 polypeptide. In certain such embodiments, the modified host cell for producing cannabinoids or cannabinoid derivatives may comprise a deletion of one or more genes encoding one or more of a ROT2 polypeptide or a PEP4 polypeptide. In some embodiments, the modified host cell for producing cannabinoids or cannabinoid derivatives may comprise a downregulation of one or more genes encoding one or more of a ROT2 polypeptide or a PEP4 polypeptide. In some embodiments, the nucleotide sequence encoding an engineered variant of the disclosure is codon-optimized. In some embodiments, the nucleotide sequences encoding the one or more of a KAR2 polypeptide, a PDI1 polypeptide, an ERO1 polypeptide, a FAD1 polypeptide, or an IRE1 polypeptide, and/or one or more polypeptides involved in cannabinoid or cannabinoid precursor (e.g., geranylpyrophosphate (GPP), prenyl phosphates, olivetolic acid, or hexanoyl-CoA) biosynthesis are codon-optimized.

The disclosure also provides modified host cells modified to express or overexpress one or more nucleic acids comprising a nucleotide sequence encoding an engineered variant of the disclosure. In some embodiments of the modified host cell for expressing an engineered variant of the disclosure, the modified host cell comprises one or more nucleic acids comprising a nucleotide sequence encoding the engineered variant of the disclosure and one or more heterologous nucleic acids disclosed herein comprising nucleotide sequences encoding one or more of a KAR2 polypeptide, a PDI1 polypeptide, an ERO1 polypeptide, a FAD1 polypeptide, or an IRE1 polypeptide. In some embodiments of the modified host cell for expressing an engineered variant of the disclosure, the modified host cell comprises one or more nucleic acids comprising a nucleotide sequence encoding the engineered variant of the disclosure and a deletion or downregulation of one or more genes encoding one or more of a ROT2 polypeptide or a PEP4 polypeptide. In certain such embodiments, the modified host cell may comprise a deletion of one or more genes encoding one or more of a ROT2 polypeptide or a PEP4 polypeptide. In some embodiments, the modified host cell may comprise a downregulation of one or more genes encoding one or more of a ROT2 polypeptide or a PEP4 polypeptide. In some embodiments of the modified host cell for expressing an engineered variant of the disclosure, the nucleotide sequence encoding the engineered variant of the disclosure is a codon-optimized nucleotide sequence. In some embodiments, the nucleotide sequences encoding the one or more of a KAR2 polypeptide, a PDI1 polypeptide, an ERO1 polypeptide, a FAD1 polypeptide, or an IRE1 polypeptide are codon-optimized. In some embodiments of the modified host cell for expressing an engineered variant of the disclosure, the modified host cell comprises one or more heterologous nucleic acids comprising nucleotide sequences encoding one or more polypeptides involved in cannabinoid or cannabinoid precursor biosynthesis. In some embodiments, the nucleotide sequences encoding the one or more polypeptides involved in cannabinoid or cannabinoid precursor biosynthesis are codon-optimized.

To produce cannabinoids or cannabinoid derivatives, expression or overexpression of one or more nucleic acids comprising a nucleotide sequence encoding an engineered variant of the disclosure in a modified host cell may be done in combination with expression or overexpression by the modified host cell of one or more heterologous nucleic acids disclosed herein (e.g., one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide) and/or with deletion or downregulation of one or more genes encoding one or more of a ROT2 polypeptide or a PEP4 polypeptide. In some embodiments, the nucleotide sequences are codon-optimized nucleotide sequences.

To express or overexpress an engineered variant of the disclosure, expression or overexpression of one or more nucleic acids comprising a nucleotide sequence encoding the engineered variant in a modified host cell may be done in combination with expression or overexpression by the modified host cell of one or more heterologous nucleic acids disclosed herein (e.g., one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide) and/or with deletion or downregulation of one or more genes encoding one or more of a ROT2 polypeptide or a PEP4 polypeptide. In some embodiments, the nucleotide sequences are codon-optimized nucleotide sequences.

In some embodiments, a modified host cell of the disclosure for producing cannabinoids or cannabinoid derivatives produces a cannabinoid or a cannabinoid derivative in an amount, as measured in mg/L or mM, greater than an amount of the cannabinoid or the cannabinoid derivative produced by a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. In some embodiments, the modified host cell for producing cannabinoids or cannabinoid derivatives produces a cannabinoid or a cannabinoid derivative in an amount, as measured in mg/L or mM, at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% greater than an amount of the cannabinoid or the cannabinoid derivative produced by a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time.

In some embodiments, a modified host cell of the disclosure comprising one or more nucleic acids comprising a nucleotide sequence encoding an engineered variant of the disclosure produces a cannabinoid or a cannabinoid derivative in an amount, as measured in mg/L or mM, greater than an amount of the cannabinoid or the cannabinoid derivative produced by a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. In some embodiments, the modified host cell comprising one or more nucleic acids comprising a nucleotide sequence encoding an engineered variant of the disclosure produces a cannabinoid or a cannabinoid derivative in an amount, as measured in mg/L or mM, at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% greater than an amount of the cannabinoid or the cannabinoid derivative produced by a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. In some embodiments of the modified host cell of the disclosure comprising one or more nucleic acids comprising a nucleotide sequence encoding an engineered variant of the disclosure, the modified host cell comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In some embodiments, a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

In some embodiments, a modified host cell of the disclosure comprising one or more nucleic acids comprising a nucleotide sequence encoding an engineered variant of the disclosure and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide produces a cannabinoid or a cannabinoid derivative in an amount, as measured in mg/L or mM, greater than an amount of the cannabinoid or the cannabinoid derivative produced by a modified host cell comprising one or more nucleic acids comprising a nucleotide sequence encoding a cannabidiolic acid synthase polypeptide having an amino acid sequence of SEQ ID NO:3 and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide, but lacking a nucleic acid comprising a nucleotide sequence encoding an engineered variant, grown under similar culture conditions for the same length of time. In some embodiments, a modified host cell of the disclosure comprising one or more nucleic acids comprising a nucleotide sequence encoding an engineered variant of the disclosure and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide produces a cannabinoid or a cannabinoid derivative in an amount, as measured in mg/L or mM, at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% greater than an amount of the cannabinoid or the cannabinoid derivative produced by a modified host cell comprising one or more nucleic acids comprising a nucleotide sequence encoding a cannabidiolic acid synthase polypeptide having an amino acid sequence of SEQ ID NO:3 and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide, but lacking a nucleic acid comprising a nucleotide sequence encoding an engineered variant, grown under similar culture conditions for the same length of time. In some embodiments of the modified host cell of the disclosure comprising one or more nucleic acids comprising a nucleotide sequence encoding an engineered variant of the disclosure and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide, the modified host cell comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In some embodiments, a modified host cell comprising one or more nucleic acids comprising a nucleotide sequence encoding a cannabidiolic acid synthase polypeptide having an amino acid sequence of SEQ ID NO:3 and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide, but lacking a nucleic acid comprising a nucleotide sequence encoding an engineered variant, comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

In some embodiments, a modified host cell of the disclosure comprising one or more nucleic acids comprising a nucleotide sequence encoding an engineered variant of the disclosure and a deletion or downregulation of one or more genes encoding one or more of a ROT2 polypeptide or a PEP4 polypeptide produces a cannabinoid or a cannabinoid derivative in an amount, as measured in mg/L or mM, greater than an amount of the cannabinoid or the cannabinoid derivative produced by a modified host cell comprising one or more nucleic acids comprising a nucleotide sequence encoding a cannabidiolic acid synthase polypeptide having an amino acid sequence of SEQ ID NO:3 and a deletion or downregulation of one or more genes encoding one or more of a ROT2 polypeptide or a PEP4 polypeptide, but lacking a nucleic acid comprising a nucleotide sequence encoding an engineered variant, grown under similar culture conditions for the same length of time. In some embodiments, a modified host cell of the disclosure comprising one or more nucleic acids comprising a nucleotide sequence encoding an engineered variant of the disclosure and a deletion or downregulation of one or more genes encoding one or more of a ROT2 polypeptide or a PEP4 polypeptide produces a cannabinoid or a cannabinoid derivative in an amount, as measured in mg/L or mM, at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% greater than an amount of the cannabinoid or the cannabinoid derivative produced by a modified host cell comprising one or more nucleic acids comprising a nucleotide sequence encoding a cannabidiolic acid synthase polypeptide having an amino acid sequence of SEQ ID NO:3 and a deletion or downregulation of one or more genes encoding one or more of a ROT2 polypeptide or a PEP4 polypeptide, but lacking a nucleic acid comprising a nucleotide sequence encoding an engineered variant, grown under similar culture conditions for the same length of time. In some embodiments of the modified host cell of the disclosure comprising one or more nucleic acids comprising a nucleotide sequence encoding an engineered variant of the disclosure and a deletion or downregulation of one or more genes encoding one or more of a ROT2 polypeptide or a PEP4 polypeptide, the modified host cell comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In some embodiments, a modified host cell comprising one or more nucleic acids comprising a nucleotide sequence encoding a cannabidiolic acid synthase polypeptide having an amino acid sequence of SEQ ID NO:3 and a deletion or downregulation of one or more genes encoding one or more of a ROT2 polypeptide or a PEP4 polypeptide, but lacking a nucleic acid comprising a nucleotide sequence encoding an engineered variant, comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

In some embodiments, a modified host cell of the disclosure comprising one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide produces a cannabinoid or a cannabinoid derivative in an amount, as measured in mg/L or mM, greater than an amount of the cannabinoid or the cannabinoid derivative produced by a modified host cell comprising one or more nucleic acids comprising a nucleotide sequence encoding a cannabidiolic acid synthase polypeptide having an amino acid sequence of SEQ ID NO:3, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide, but lacking a nucleic acid comprising a nucleotide sequence encoding an engineered variant, grown under similar culture conditions for the same length of time. In some embodiments, a modified host cell of the disclosure comprising one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide produces a cannabinoid or a cannabinoid derivative in an amount, as measured in mg/L or mM, at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% greater than an amount of the cannabinoid or the cannabinoid derivative produced by a modified host cell comprising one or more nucleic acids comprising a nucleotide sequence encoding a cannabidiolic acid synthase polypeptide having an amino acid sequence of SEQ ID NO:3, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide, but lacking a nucleic acid comprising a nucleotide sequence encoding an engineered variant, grown under similar culture conditions for the same length of time. In some embodiments of the modified host cell of the disclosure comprising one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide, the modified host cell comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In some embodiments, a modified host cell comprising one or more nucleic acids comprising a nucleotide sequence encoding a cannabidiolic acid synthase polypeptide having an amino acid sequence of SEQ ID NO:3, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide, but lacking a nucleic acid comprising a nucleotide sequence encoding an engineered variant, comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

In some embodiments, the modified host cell of the disclosure for producing cannabinoids or cannabinoid derivatives has a growth rate and/or biomass yield similar to, or lower than, a growth rate and/or biomass yield of a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. In some embodiments, the modified host cell of the disclosure for producing cannabinoids or cannabinoid derivatives has a growth rate and/or biomass yield similar to, or lower than, a growth rate and/or biomass yield and an increased titer of CBDA compared to a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time.

In some embodiments, the modified host cell of the disclosure for producing cannabinoids or cannabinoid derivatives has a faster growth rate and/or higher biomass yield compared to a growth rate and/or higher biomass yield of a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. In some embodiments, the modified host cell of the disclosure for producing cannabinoids or cannabinoid derivatives has a growth rate and/or higher biomass yield at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% faster than a growth rate and/or higher biomass yield of a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time.

In some embodiments, the modified host cell of the disclosure for expressing an engineered variant of the disclosure has a growth rate and/or biomass yield similar to, or lower than, a growth rate and/or biomass yield of a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. In some embodiments, the modified host cell of the disclosure for expressing an engineered variant of the disclosure has a growth rate and/or biomass yield similar to, or lower than, a growth rate and/or biomass yield and an increased titer of CBDA compared to a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time.

In some embodiments, the modified host cell of the disclosure for expressing an engineered variant of the disclosure has a faster growth rate and/or higher biomass yield compared to a growth rate and/or higher biomass yield of a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. In some embodiments, the modified host cell of the disclosure for expressing an engineered variant of the disclosure has a growth rate and/or higher biomass yield at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% faster than a growth rate and/or higher biomass yield of a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time.

In some embodiments, the modified host cell of the disclosure comprising one or more nucleic acids comprising a nucleotide sequence encoding an engineered variant of the disclosure has a growth rate and/or biomass yield similar to, or lower than, a growth rate and/or biomass yield of a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. In some embodiments, the modified host cell of the disclosure comprising one or more nucleic acids comprising a nucleotide sequence encoding an engineered variant of the disclosure has a growth rate and/or biomass yield similar to, or lower than, a growth rate and/or biomass yield and an increased titer of CBDA compared to a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time.

In some embodiments, a modified host cell of the disclosure comprising one or more nucleic acids comprising a nucleotide sequence encoding an engineered variant of the disclosure has a faster growth rate and/or higher biomass yield compared to a growth rate and/or higher biomass yield of a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. In some embodiments, the modified host cell of the disclosure comprising one or more nucleic acids comprising a nucleotide sequence encoding an engineered variant of the disclosure has a growth rate and/or higher biomass yield at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% faster than a growth rate and/or higher biomass yield of a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. In some embodiments of the modified host cell of the disclosure comprising one or more nucleic acids comprising a nucleotide sequence encoding an engineered variant of the disclosure, the modified host cell comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In some embodiments, a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

In some embodiments, a modified host cell of the disclosure comprising one or more nucleic acids comprising a nucleotide sequence encoding an engineered variant of the disclosure and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide has a faster growth rate and/or higher biomass yield compared to a growth rate and/or higher biomass yield of a modified host cell comprising one or more nucleic acids comprising a nucleotide sequence encoding a cannabidiolic acid synthase polypeptide having an amino acid sequence of SEQ ID NO:3 and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide, but lacking a nucleic acid comprising a nucleotide sequence encoding an engineered variant, grown under similar culture conditions for the same length of time. In some embodiments, a modified host cell of the disclosure comprising one or more nucleic acids comprising a nucleotide sequence encoding an engineered variant of the disclosure and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide has a growth rate and/or higher biomass yield at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% faster than a growth rate and/or higher biomass yield of a modified host cell comprising one or more nucleic acids comprising a nucleotide sequence encoding a cannabidiolic acid synthase polypeptide having an amino acid sequence of SEQ ID NO:3 and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide, but lacking a nucleic acid comprising a nucleotide sequence encoding an engineered variant, grown under similar culture conditions for the same length of time. In some embodiments of the modified host cell of the disclosure comprising one or more nucleic acids comprising a nucleotide sequence encoding an engineered variant of the disclosure and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide, the modified host cells comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In some embodiments, a modified host cell comprising one or more nucleic acids comprising a nucleotide sequence encoding a cannabidiolic acid synthase polypeptide having an amino acid sequence of SEQ ID NO:3 and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide, but lacking a nucleic acid comprising a nucleotide sequence encoding an engineered variant, comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

In some embodiments, a modified host cell of the disclosure comprising one or more nucleic acids comprising a nucleotide sequence encoding an engineered variant of the disclosure and a deletion or downregulation of one or more genes encoding one or more of a ROT2 polypeptide or a PEP4 polypeptide has a faster growth rate and/or higher biomass yield compared to a growth rate and/or higher biomass yield of a modified host cell comprising one or more nucleic acids comprising a nucleotide sequence encoding a cannabidiolic acid synthase polypeptide having an amino acid sequence of SEQ ID NO:3 and a deletion or downregulation of one or more genes encoding one or more of a ROT2 polypeptide or a PEP4 polypeptide, but lacking a nucleic acid comprising a nucleotide sequence encoding an engineered variant, grown under similar culture conditions for the same length of time. In some embodiments, a modified host cell of the disclosure comprising one or more nucleic acids comprising a nucleotide sequence encoding an engineered variant of the disclosure and a deletion or downregulation of one or more genes encoding one or more of a ROT2 polypeptide or a PEP4 polypeptide has a growth rate and/or higher biomass yield at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% faster than a growth rate and/or higher biomass yield of a modified host cell comprising one or more nucleic acids comprising a nucleotide sequence encoding a cannabidiolic acid synthase polypeptide having an amino acid sequence of SEQ ID NO:3 and a deletion or downregulation of one or more genes encoding one or more of a ROT2 polypeptide or a PEP4 polypeptide, but lacking a nucleic acid comprising a nucleotide sequence encoding an engineered variant, grown under similar culture conditions for the same length of time. In some embodiments of the modified host cell of the disclosure comprising one or more nucleic acids comprising a nucleotide sequence encoding an engineered variant of the disclosure and a deletion or downregulation of one or more genes encoding one or more of a ROT2 polypeptide or a PEP4 polypeptide, the modified host cell comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In some embodiments, a modified host cell comprising one or more nucleic acids comprising a nucleotide sequence encoding a cannabidiolic acid synthase polypeptide having an amino acid sequence of SEQ ID NO:3 and a deletion or downregulation of one or more genes encoding one or more of a ROT2 polypeptide or a PEP4 polypeptide, but lacking a nucleic acid comprising a nucleotide sequence encoding an engineered variant, comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

In some embodiments, a modified host cell of the disclosure comprising one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide has a faster growth rate and/or higher biomass yield compared to a growth rate and/or higher biomass yield of a modified host cell comprising one or more nucleic acids comprising a nucleotide sequence encoding a cannabidiolic acid synthase polypeptide having an amino acid sequence of SEQ ID NO:3, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide, but lacking a nucleic acid comprising a nucleotide sequence encoding an engineered variant, grown under similar culture conditions for the same length of time. In some embodiments, a modified host cell of the disclosure comprising one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide has a growth rate and/or higher biomass yield at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% faster than a growth rate and/or higher biomass yield of a modified host cell comprising one or more nucleic acids comprising a nucleotide sequence encoding a cannabidiolic acid synthase polypeptide having an amino acid sequence of SEQ ID NO:3, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide, but lacking a nucleic acid comprising a nucleotide sequence encoding an engineered variant, grown under similar culture conditions for the same length of time. In some embodiments of the modified host cell of the disclosure comprising one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide, the modified host cell comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In some embodiments, a modified host cell comprising one or more nucleic acids comprising a nucleotide sequence encoding a cannabidiolic acid synthase polypeptide having an amino acid sequence of SEQ ID NO:3, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide, but lacking a nucleic acid comprising a nucleotide sequence encoding an engineered variant, comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

In some embodiments, a modified host cell of the disclosure for producing cannabinoids or cannabinoid derivatives produces CBDA from CBGA in an increased ratio of CBDA over THCA compared to that produced by a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. In some embodiments, the modified host cell for producing cannabinoids or cannabinoid derivatives produces CBDA from CBGA in a ratio of CBDA over THCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

In some embodiments, a modified host cell of the disclosure for expressing an engineered variant of the disclosure produces CBDA from CBGA in an increased ratio of CBDA over THCA compared to that produced by a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. In some embodiments, the modified host cell for expressing an engineered variant of the disclosure produces CBDA from CBGA in a ratio of CBDA over THCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

In some embodiments, a modified host cell of the disclosure comprising one or more nucleic acids comprising a nucleotide sequence encoding an engineered variant of the disclosure produces CBDA from CBGA in an increased ratio of CBDA over THCA compared to that produced by a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. In some embodiments, a modified host cell of the disclosure comprising one or more nucleic acids comprising a nucleotide sequence encoding an engineered variant of the disclosure produces CBDA from CBGA in a ratio of CBDA over THCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1. In some embodiments of the modified host cell of the disclosure comprising one or more nucleic acids comprising a nucleotide sequence encoding an engineered variant of the disclosure, the modified host cell comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In some embodiments, a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

In some embodiments, a modified host cell of the disclosure comprising one or more nucleic acids comprising a nucleotide sequence encoding an engineered variant of the disclosure and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide produces CBDA from CBGA in an increased ratio of CBDA over THCA compared to that produced by a modified host cell comprising one or more nucleic acids comprising a nucleotide sequence encoding a cannabidiolic acid synthase polypeptide having an amino acid sequence of SEQ ID NO:3 and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide, but lacking a nucleic acid comprising a nucleotide sequence encoding an engineered variant, grown under similar culture conditions for the same length of time. In some embodiments, a modified host cell of the disclosure comprising one or more nucleic acids comprising a nucleotide sequence encoding an engineered variant of the disclosure and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide produces CBDA from CBGA in a ratio of CBDA over THCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1. In some embodiments of the modified host cell of the disclosure comprising one or more nucleic acids comprising a nucleotide sequence encoding an engineered variant of the disclosure and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide, the modified host cell comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In some embodiments, a modified host cell comprising one or more nucleic acids comprising a nucleotide sequence encoding a cannabidiolic acid synthase polypeptide having an amino acid sequence of SEQ ID NO:3 and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide, but lacking a nucleic acid comprising a nucleotide sequence encoding an engineered variant, comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

In some embodiments, a modified host cell of the disclosure comprising one or more nucleic acids comprising a nucleotide sequence encoding an engineered variant of the disclosure and a deletion or downregulation of one or more genes encoding one or more of a ROT2 polypeptide or a PEP4 polypeptide produces CBDA from CBGA in an increased ratio of CBDA over THCA compared to that produced by a modified host cell comprising one or more nucleic acids comprising a nucleotide sequence encoding a cannabidiolic acid synthase polypeptide having an amino acid sequence of SEQ ID NO:3 and a deletion or downregulation of one or more genes encoding one or more of a ROT2 polypeptide or a PEP4 polypeptide, but lacking a nucleic acid comprising a nucleotide sequence encoding an engineered variant, grown under similar culture conditions for the same length of time. In some embodiments, a modified host cell of the disclosure comprising one or more nucleic acids comprising a nucleotide sequence encoding an engineered variant of the disclosure and a deletion or downregulation of one or more genes encoding one or more of a ROT2 polypeptide or a PEP4 polypeptide produces CBDA from CBGA in a ratio of CBDA over THCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1. In some embodiments of the modified host cell of the disclosure comprising one or more nucleic acids comprising a nucleotide sequence encoding an engineered variant of the disclosure and a deletion or downregulation of one or more genes encoding one or more of a ROT2 polypeptide or a PEP4 polypeptide, the modified host cell comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In some embodiments, a modified host cell comprising one or more nucleic acids comprising a nucleotide sequence encoding a cannabidiolic acid synthase polypeptide having an amino acid sequence of SEQ ID NO:3 and a deletion or downregulation of one or more genes encoding one or more of a ROT2 polypeptide or a PEP4 polypeptide, but lacking a nucleic acid comprising a nucleotide sequence encoding an engineered variant, comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

In some embodiments, a modified host cell of the disclosure comprising one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide produces CBDA from CBGA in an increased ratio of CBDA over THCA compared to that produced by a modified host cell comprising one or more nucleic acids comprising a nucleotide sequence encoding a cannabidiolic acid synthase polypeptide having an amino acid sequence of SEQ ID NO:3, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide, but lacking a nucleic acid comprising a nucleotide sequence encoding an engineered variant, grown under similar culture conditions for the same length of time. In some embodiments, a modified host cell of the disclosure comprising one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide produces CBDA from CBGA in a ratio of CBDA over THCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1. In some embodiments of the modified host cell of the disclosure comprising one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide, the modified host cell comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In some embodiments, a modified host cell comprising one or more nucleic acids comprising a nucleotide sequence encoding a cannabidiolic acid synthase polypeptide having an amino acid sequence of SEQ ID NO:3, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide, but lacking a nucleic acid comprising a nucleotide sequence encoding an engineered variant, comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

In some embodiments, a modified host cell of the disclosure for producing cannabinoids or cannabinoid derivatives produces CBDA from CBGA in an increased ratio of CBDA over CBCA compared to that produced by a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. In some embodiments, the modified host cell for producing cannabinoids or cannabinoid derivatives produces CBDA from CBGA in a ratio of CBDA over CBCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

In some embodiments, a modified host cell of the disclosure for expressing an engineered variant of the disclosure produces CBDA from CBGA in an increased ratio of CBDA over CBCA compared to that produced by a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. In some embodiments, the modified host cell for expressing an engineered variant of the disclosure produces CBDA from CBGA in a ratio of CBDA over CBCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

In some embodiments, a modified host cell of the disclosure comprising one or more nucleic acids comprising a nucleotide sequence encoding an engineered variant of the disclosure produces CBDA from CBGA in an increased ratio of CBDA over CBCA compared to that produced by a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. In some embodiments, a modified host cell of the disclosure comprising one or more nucleic acids comprising a nucleotide sequence encoding an engineered variant of the disclosure produces CBDA from CBGA in a ratio of CBDA over CBCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1. In some embodiments of the modified host cell of the disclosure comprising one or more nucleic acids comprising a nucleotide sequence encoding an engineered variant of the disclosure, the modified host cell comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In some embodiments, a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

In some embodiments, a modified host cell of the disclosure comprising one or more nucleic acids comprising a nucleotide sequence encoding an engineered variant of the disclosure and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide produces CBDA from CBGA in an increased ratio of CBDA over CBCA compared to that produced by a modified host cell comprising one or more nucleic acids comprising a nucleotide sequence encoding a cannabidiolic acid synthase polypeptide having an amino acid sequence of SEQ ID NO:3 and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide, but lacking a nucleic acid comprising a nucleotide sequence encoding an engineered variant, grown under similar culture conditions for the same length of time. In some embodiments, a modified host cell of the disclosure comprising one or more nucleic acids comprising a nucleotide sequence encoding an engineered variant of the disclosure and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide produces CBDA from CBGA in a ratio of CBDA over CBCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1. In some embodiments of the modified host cell of the disclosure comprising one or more nucleic acids comprising a nucleotide sequence encoding an engineered variant of the disclosure and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide, the modified host cell comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In some embodiments, a modified host cell comprising one or more nucleic acids comprising a nucleotide sequence encoding a cannabidiolic acid synthase polypeptide having an amino acid sequence of SEQ ID NO:3 and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide, but lacking a nucleic acid comprising a nucleotide sequence encoding an engineered variant, comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

In some embodiments, a modified host cell of the disclosure comprising one or more nucleic acids comprising a nucleotide sequence encoding an engineered variant of the disclosure and a deletion or downregulation of one or more genes encoding one or more of a ROT2 polypeptide or a PEP4 polypeptide produces CBDA from CBGA in an increased ratio of CBDA over CBCA compared to that produced by a modified host cell comprising one or more nucleic acids comprising a nucleotide sequence encoding a cannabidiolic acid synthase polypeptide having an amino acid sequence of SEQ ID NO:3 and a deletion or downregulation of one or more genes encoding one or more of a ROT2 polypeptide or a PEP4 polypeptide, but lacking a nucleic acid comprising a nucleotide sequence encoding an engineered variant, grown under similar culture conditions for the same length of time. In some embodiments, a modified host cell of the disclosure comprising one or more nucleic acids comprising a nucleotide sequence encoding an engineered variant of the disclosure and a deletion or downregulation of one or more genes encoding one or more of a ROT2 polypeptide or a PEP4 polypeptide produces CBDA from CBGA in a ratio of CBDA over CBCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1. In some embodiments of the modified host cell of the disclosure comprising one or more nucleic acids comprising a nucleotide sequence encoding an engineered variant of the disclosure and a deletion or downregulation of one or more genes encoding one or more of a ROT2 polypeptide or a PEP4 polypeptide, the modified host cell comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In some embodiments, a modified host cell comprising one or more nucleic acids comprising a nucleotide sequence encoding a cannabidiolic acid synthase polypeptide having an amino acid sequence of SEQ ID NO:3 and a deletion or downregulation of one or more genes encoding one or more of a ROT2 polypeptide or a PEP4 polypeptide, but lacking a nucleic acid comprising a nucleotide sequence encoding an engineered variant, comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

In some embodiments, a modified host cell of the disclosure comprising one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide produces CBDA from CBGA in an increased ratio of CBDA over CBCA compared to that produced by a modified host cell comprising one or more nucleic acids comprising a nucleotide sequence encoding a cannabidiolic acid synthase polypeptide having an amino acid sequence of SEQ ID NO:3, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide, but lacking a nucleic acid comprising a nucleotide sequence encoding an engineered variant, grown under similar culture conditions for the same length of time. In some embodiments, a modified host cell of the disclosure comprising one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide produces CBDA from CBGA in a ratio of CBDA over CBCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1. In some embodiments of the modified host cell of the disclosure comprising one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide, the modified host cell comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In some embodiments, a modified host cell comprising one or more nucleic acids comprising a nucleotide sequence encoding a cannabidiolic acid synthase polypeptide having an amino acid sequence of SEQ ID NO:3, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide, but lacking a nucleic acid comprising a nucleotide sequence encoding an engineered variant, comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

In some embodiments, the growth and/or viability of modified host cells of the disclosure for producing cannabinoids or cannabinoid derivatives is not significantly decreased compared to the growth and/or viability of an unmodified host cell. In some embodiments, a culture of modified host cells of the disclosure for producing cannabinoids or cannabinoid derivatives has a cell density that is at least 25% or greater, at least 30% or greater, at least 35% or greater, at least 40% or greater, at least 45% or greater, at least 50% or greater, at least 55% or greater, at least 60% or greater, at least 65% or greater, at least 70% or greater, at least 75% or greater, at least 80% or greater, at least 85% or greater at least 90% or greater, at least 95% or greater, at least 100% or greater, at least 110% or greater, at least 120% or greater, at least 130% or greater, at least 140% or greater, or at least 150% or greater than the cell density of a culture of unmodified control host cells grown for the same period, in the same culture medium, and under the same culture conditions.

In some embodiments, the growth and/or viability of modified host cells of the disclosure for expressing an engineered variant of the disclosure is not significantly decreased compared to the growth and/or viability of an unmodified host cell. In some embodiments, a culture of modified host cells of the disclosure for expressing an engineered variant of the disclosure has a cell density that is at least 25% or greater, at least 30% or greater, at least 35% or greater, at least 40% or greater, at least 45% or greater, at least 50% or greater, at least 55% or greater, at least 60% or greater, at least 65% or greater, at least 70% or greater, at least 75% or greater, at least 80% or greater, at least 85% or greater at least 90% or greater, at least 95% or greater, at least 100% or greater, at least 110% or greater, at least 120% or greater, at least 130% or greater, at least 140% or greater, or at least 150% or greater than the cell density of a culture of unmodified control host cells grown for the same period, in the same culture medium, and under the same culture conditions.

In some embodiments, the growth and/or viability of modified host cells of the disclosure comprising one or more nucleic acids comprising a nucleotide sequence encoding an engineered variant of the disclosure is not significantly decreased compared to the growth and/or viability of an unmodified host cell. In some embodiments, a culture of modified host cells of the disclosure comprising one or more nucleic acids comprising a nucleotide sequence encoding an engineered variant of the disclosure has a cell density that is at least 25% or greater, at least 30% or greater, at least 35% or greater, at least 40% or greater, at least 45% or greater, at least 50% or greater, at least 55% or greater, at least 60% or greater, at least 65% or greater, at least 70% or greater, at least 75% or greater, at least 80% or greater, at least 85% or greater at least 90% or greater, at least 95% or greater, at least 100% or greater, at least 110% or greater, at least 120% or greater, at least 130% or greater, at least 140% or greater, or at least 150% or greater than the cell density of a culture of unmodified control host cells grown for the same period, in the same culture medium, and under the same culture conditions. In some embodiments of the modified host cell of the disclosure comprising one or more nucleic acids comprising a nucleotide sequence encoding an engineered variant of the disclosure, the modified host cell comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

In some embodiments, the growth and/or viability of modified host cells of the disclosure comprising one or more nucleic acids comprising a nucleotide sequence encoding an engineered variant of the disclosure and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide is not significantly decreased compared to the growth and/or viability of an unmodified host cell. In some embodiments, a culture of modified host cells of the disclosure comprising one or more nucleic acids comprising a nucleotide sequence encoding an engineered variant of the disclosure and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide has a cell density that is at least 25% or greater, at least 30% or greater, at least 35% or greater, at least 40% or greater, at least 45% or greater, at least 50% or greater, at least 55% or greater, at least 60% or greater, at least 65% or greater, at least 70% or greater, at least 75% or greater, at least 80% or greater, at least 85% or greater at least 90% or greater, at least 95% or greater, at least 100% or greater, at least 110% or greater, at least 120% or greater, at least 130% or greater, at least 140% or greater, or at least 150% or greater than the cell density of a culture of unmodified control host cells grown for the same period, in the same culture medium, and under the same culture conditions. In some embodiments of the modified host cell of the disclosure comprising one or more nucleic acids comprising a nucleotide sequence encoding an engineered variant of the disclosure and one or more heterologous nucleic acids comprising nucleotide sequences encoding one or more of a KAR2 polypeptide, a PDI1 polypeptide, an ERO1 polypeptide, a FAD1 polypeptide, or an IRE1 polypeptide, the modified host cell comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

In some embodiments, the growth and/or viability of modified host cells of the disclosure comprising one or more nucleic acids comprising a nucleotide sequence encoding an engineered variant of the disclosure and a deletion or downregulation of one or more genes encoding one or more of a ROT2 polypeptide or a PEP4 polypeptide is not significantly decreased compared to the growth and/or viability of an unmodified host cell. In some embodiments, a culture of modified host cells of the disclosure comprising one or more nucleic acids comprising a nucleotide sequence encoding an engineered variant of the disclosure and a deletion or downregulation of one or more genes encoding one or more of a ROT2 polypeptide or a PEP4 polypeptide has a cell density that is at least 25% or greater, at least 30% or greater, at least 35% or greater, at least 40% or greater, at least 45% or greater, at least 50% or greater, at least 55% or greater, at least 60% or greater, at least 65% or greater, at least 70% or greater, at least 75% or greater, at least 80% or greater, at least 85% or greater at least 90% or greater, at least 95% or greater, at least 100% or greater, at least 110% or greater, at least 120% or greater, at least 130% or greater, at least 140% or greater, or at least 150% or greater than the cell density of a culture of unmodified control host cells grown for the same period, in the same culture medium, and under the same culture conditions. In some embodiments of the modified host cell of the disclosure comprising one or more nucleic acids comprising a nucleotide sequence encoding an engineered variant of the disclosure and a deletion or downregulation of one or more genes encoding one or more of a ROT2 polypeptide or a PEP4 polypeptide, the modified host cell comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

In some embodiments, the growth and/or viability of modified host cells of the disclosure comprising one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide is not significantly decreased compared to the growth and/or viability of an unmodified host cell. In some embodiments, a culture of modified host cells of the disclosure comprising one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide has a cell density that is at least 25% or greater, at least 30% or greater, at least 35% or greater, at least 40% or greater, at least 45% or greater, at least 50% or greater, at least 55% or greater, at least 60% or greater, at least 65% or greater, at least 70% or greater, at least 75% or greater, at least 80% or greater, at least 85% or greater at least 90% or greater, at least 95% or greater, at least 100% or greater, at least 110% or greater, at least 120% or greater, at least 130% or greater, at least 140% or greater, or at least 150% or greater than the cell density of a culture of unmodified control host cells grown for the same period, in the same culture medium, and under the same culture conditions. In some embodiments of the modified host cell of the disclosure comprising one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide, the modified host cell comprises one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis.

Suitable Host Cells

Parent host cells that are suitable for use in generating a modified host cell of the present disclosure may include eukaryotic cells. In some embodiments, the eukaryotic cells are yeast cells.

Host cells (including parent host cells and modified host cells) are in some embodiments unicellular organisms, or are grown in culture as single cells. In some embodiments, the host cell is a eukaryotic cell. Suitable eukaryotic host cells may include, but are not limited to, yeast cells and fungal cells. Suitable eukaryotic host cells may include, but are not limited to, *Pichia pastoris* (now known as *Komagataella phaffii*), *Pichia finlandica, Pichia trehalophila, Pichia koclamae, Pichia membranaefaciens, Pichia opuntiae, Pichia thermotolerans, Pichia salictaria, Pichia guercuum, Pichia pijperi, Pichia stiptis, Pichia methanolica, Pichia* sp., *Saccharomyces cerevisiae, Saccharomyces* sp., *Hansenula polymorpha* (now known as *Pichia angusta*), *Yarrowia lipolytica, Kluyveromyces* sp., *Kluyveromyces lactis, Kluyveromyces marxianus, Schizosaccharomyces pombe, Scheffersomyces stipites, Dekkera bruxellensis, Blastobotrys adeninivorans* (formerly *Arxula adeninivorans*), *Candida albicans, Aspergillus nidulans, Aspergillus niger, Aspergillus oryzae, Trichoderma reesei, Chrysosporium lucknowense, Fusarium* sp., *Fusarium gramineum, Fusarium venenatum, Neurospora crassa*, and the like. In some embodiments, the modified host cell disclosed herein is cultured in vitro.

In some embodiments, the host cell of the disclosure is a yeast cell. In some embodiments, the host cell is a protease-deficient strain of *Saccharomyces cerevisiae*. Protease-deficient yeast strains may be effective in reducing the degradation of expressed heterologous proteins. Examples of proteases deleted in such strains may include one or more of the following: PEP4, PRB1, and KEX1.

In some embodiments, the host cell is *Saccharomyces cerevisiae*. In some embodiments, the host cell for use in generating a modified host cell of the present disclosure may be selected because of ease of culture; rapid growth; availability of tools for modification, such as promoters and vectors; and the host cell's safety profile. In some embodiments, the host cell for use in generating a modified host cell of the present disclosure may be selected because of its ability or inability to introduce certain posttranslational modifications onto expressed polypeptides, such as engineered variants of the disclosure. For instance, modified *Komagataella phaffii* host cells may hyperglycosylate engineered variants of the disclosure and hyperglycosylation may alter the activity of the resultant expressed polypeptide.

Genetic Modification of Host Cells and Exemplary Modified Host Cells of the Disclosure The present disclosure provides for modified host cells and methods of making modified host cells comprising one or more nucleic acids comprising a nucleotide sequence encoding an engineered variant of the disclosure. In some embodiments, the method of making a modified host cell of the disclosure comprises introducing into a host cell one or more nucleic acids comprising a nucleotide sequence encoding an engineered variant of the disclosure. In some embodiments, the modified host cell of the disclosure comprises one or more nucleic acids comprising a nucleotide sequence encoding an engineered variant of the disclosure. In some embodiments, the nucleic acids comprise codon-optimized nucleotide sequences. In some embodiments, the nucleotide sequence encoding an engineered variant of the disclosure is codon-optimized. In some embodiments, the nucleotide sequences encoding the one or more of a KAR2 polypeptide, a PDI1 polypeptide, an ERO1 polypeptide, a FAD1 polypeptide, or an IRE1 polypeptide, and/or one or more polypeptides involved in cannabinoid or cannabinoid precursor (e.g., geranylpyrophosphate (GPP), prenyl phosphates, olivetolic acid, or hexanoyl-CoA) biosynthesis are codon-optimized.

The present disclosure provides for modified host cells and methods of making modified host cells for producing a cannabinoid or a cannabinoid derivative, the method comprising introducing into a host cell one or more nucleic acids (e.g., heterologous) disclosed herein. In some embodiments, the nucleic acids comprise codon-optimized nucleotide sequences.

The disclosure provides a method of making a modified host cell for producing a cannabinoid or a cannabinoid derivative, the method comprising a) introducing into a host cell one or more nucleic acids comprising a nucleotide sequence encoding an engineered variant of the disclosure. In certain such embodiments, the method comprises b) introducing into the host cell one or more heterologous nucleic acids comprising nucleotide sequences encoding one or more of a KAR2 polypeptide, a PDI1 polypeptide, an ERO1 polypeptide, or an IRE1 polypeptide. In some embodiments, the method comprises b) introducing into the host cell one or more heterologous nucleic acids comprising nucleotide sequences encoding one or more of a KAR2 polypeptide, a PDI1 polypeptide, an ERO1 polypeptide, or a FAD1 polypeptide. In some embodiments, the nucleotide sequences are codon-optimized.

In some embodiments, the modified host cell for producing a cannabinoid or a cannabinoid derivative comprises one or more heterologous nucleic acids comprising nucleotide sequences encoding an engineered variant of the disclosure and one or more heterologous nucleic acids comprising nucleotide sequences encoding one or more of a KAR2 polypeptide, a PDI1 polypeptide, an ERO1 polypeptide, or an IRE1 polypeptide. In certain such embodiments, the modified host cell comprises one or more heterologous nucleic acids comprising a nucleotide sequence encoding the KAR2 polypeptide, one or more heterologous nucleic acids comprising a nucleotide sequence encoding the PDI1 polypeptide, one or more heterologous nucleic acids comprising a nucleotide sequence encoding the ERO1 polypeptide, and one or more heterologous nucleic acids comprising a nucleotide sequence encoding the IRE1 polypeptide. In some embodiments, the modified host cell for producing a cannabinoid or a cannabinoid derivative comprises two or more heterologous nucleic acids comprising a nucleotide sequence encoding a KAR2 polypeptide.

In some embodiments, the modified host cell for producing a cannabinoid or a cannabinoid derivative comprises one or more heterologous nucleic acids comprising nucleotide sequences encoding an engineered variant of the disclosure and one or more heterologous nucleic acids comprising nucleotide sequences encoding one or more of a KAR2 polypeptide, a PDI1 polypeptide, an ERO1 polypeptide, or a FAD1 polypeptide. In certain such embodiments, the modified host cell comprises one or more heterologous nucleic acids comprising a nucleotide sequence encoding the KAR2 polypeptide, one or more heterologous nucleic acids comprising a nucleotide sequence encoding the PDI1 polypeptide, one or more heterologous nucleic acids comprising a nucleotide sequence encoding the ERO1 polypeptide, and one or more heterologous nucleic acids comprising a nucleotide sequence encoding the FAD1 polypeptide. In some embodiments, the modified host cell for producing a cannabinoid or a cannabinoid derivative comprises two or more heterologous nucleic acids comprising a nucleotide sequence encoding a KAR2 polypeptide.

In some embodiments, the modified host cell for producing a cannabinoid or a cannabinoid derivative comprises one or more nucleic acids comprising a nucleotide sequence encoding an engineered variant of the disclosure and a deletion or downregulation of one or more genes encoding one or more of a ROT2 polypeptide or a PEP4 polypeptide. In certain such embodiments, the modified host cell comprises a deletion or downregulation of one or more genes encoding the ROT2 polypeptide and the PEP4 polypeptide. The disclosure provides a method of making a modified host cell for producing a cannabinoid or a cannabinoid derivative, the method comprising introducing into a host cell one or more nucleic acids comprising a nucleotide sequence encoding an engineered variant of the disclosure and a deletion or downregulation of one or more genes encoding one or more of a ROT2 polypeptide or a PEP4 polypeptide.

In some embodiments, the modified host cell for producing a cannabinoid or a cannabinoid derivative comprises one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide. In certain such embodiments, the modified host cell comprises one or more heterologous nucleic acids comprising a nucleotide sequence encoding the KAR2 polypeptide, one or more heterologous nucleic acids comprising a nucleotide sequence encoding the PDI1 polypeptide, one or more heterologous nucleic acids comprising a nucleotide sequence encoding the ERO1 polypeptide, and one or more heterologous nucleic acids comprising a nucleotide sequence encoding the IRE1 polypeptide and a deletion or downregulation of one or more genes encoding the ROT2 polypeptide and the PEP4 polypeptide. In some embodiments, the modified host cell for producing a cannabinoid or a cannabinoid derivative comprises two or more heterologous nucleic acids comprising a nucleotide sequence encoding a KAR2 polypeptide.

The disclosure provides a method of making a modified host cell for producing a cannabinoid or a cannabinoid derivative, the method comprising introducing into a host cell: a) one or more nucleic acids comprising a nucleotide sequence encoding an engineered variant of the disclosure, b) one or more heterologous nucleic acids comprising nucleotide sequences encoding one or more of a KAR2 polypeptide, a PDI1 polypeptide, an ERO1 polypeptide, or an IRE1 polypeptide, and c) a deletion or downregulation of one or more genes encoding one or more of a ROT2 polypeptide or a PEP4 polypeptide.

The disclosure provides a method of making a modified host cell for producing a cannabinoid or a cannabinoid derivative, the method comprising introducing into a host cell: a) one or more nucleic acids comprising a nucleotide sequence encoding an engineered variant of the disclosure and b) one or more heterologous nucleic acids comprising nucleotide sequences encoding one or more of a KAR2 polypeptide, a PDI1 polypeptide, an ERO1 polypeptide, or a FAD1 polypeptide.

In some embodiments, the modified host cell for producing a cannabinoid or a cannabinoid derivative may comprise one or more nucleic acids comprising a nucleotide sequence encoding an engineered variant of the disclosure and express or overexpress combinations of heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In some embodiments, the methods of making a modified host cell for producing a cannabinoid or a cannabinoid derivative comprise introducing into a host cell one or more heterologous nucleic acids comprising nucleotide sequences encoding one or more polypeptides involved in cannabinoid or cannabinoid precursor biosynthesis. In some embodiments disclosed herein, the nucleotide sequences encoding the one or more polypeptides involved in cannabinoid or cannabinoid precursor biosynthesis are codon-optimized.

In some embodiments, the modified host cell for producing a cannabinoid or a cannabinoid derivative comprises one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or an IRE1 polypeptide, a deletion or downregulation of one or more genes encoding one or more of a ROT2 polypeptide or a PEP4 polypeptide, and one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In certain such embodiments, the modified host cell comprises one or more heterologous nucleic acids comprising a nucleotide sequence encoding the KAR2 polypeptide, one or more heterologous nucleic acids comprising a nucleotide sequence encoding the PDI1 polypeptide, one or more heterologous nucleic acids comprising a nucleotide sequence encoding the ERO1 polypeptide, one or more heterologous nucleic acids comprising a nucleotide sequence encoding the IRE1 polypeptide and a deletion or downregulation of the genes encoding the ROT2 polypeptide and the PEP4 polypeptide. In some embodiments, the modified host cell for producing a cannabinoid or a cannabinoid derivative comprises two or more heterologous nucleic acids comprising a nucleotide sequence encoding a KAR2 polypeptide.

In some embodiments, the modified host cell for producing a cannabinoid or a cannabinoid derivative comprises one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or a FAD1 polypeptide, and one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In certain such embodiments, the modified host cell comprises one or more heterologous nucleic acids comprising a nucleotide sequence encoding the KAR2 polypeptide, one or more heterologous nucleic acids comprising a nucleotide sequence encoding the PDI1 polypeptide, one or more heterologous nucleic acids comprising a nucleotide sequence encoding the ERO1 polypeptide, and one or more heterologous nucleic acids comprising a nucleotide sequence encoding the FAD1 polypeptide. In some embodiments, the modified host cell for producing a cannabinoid or a cannabinoid derivative comprises two or more heterologous nucleic acids comprising a nucleotide sequence encoding a KAR2 polypeptide.

The present disclosure provides for a method of making a modified host cell for expressing an engineered variant of the disclosure, the method comprising introducing into a host cell one or more nucleic acids disclosed herein. The disclosure provides a method of making a modified host cell for expressing an engineered variant of the disclosure, the method comprising introducing into a host cell: a) one or more nucleic acids comprising a nucleotide sequence encoding an engineered variant of the disclosure and b) one or more heterologous nucleic acids comprising nucleotide sequences encoding one or more of a KAR2 polypeptide, a PDI1 polypeptide, an ERO1 polypeptide, or an IRE1 polypeptide. The disclosure provides a method of making a modified host cell for expressing an engineered variant of the disclosure, the method comprising introducing into a host cell: a) one or more nucleic acids comprising a nucleotide sequence encoding an engineered variant of the disclosure and b) one or more heterologous nucleic acids comprising nucleotide sequences encoding one or more of a KAR2 polypeptide, a PDI1 polypeptide, an ERO1 polypeptide, or a FAD1 polypeptide. In some embodiments, the nucleotide sequences are codon-optimized.

In some embodiments, the modified host cell for expressing an engineered variant of the disclosure comprises one or more nucleic acids comprising a nucleotide sequence encoding the engineered variant of the disclosure and comprises one or more heterologous nucleic acids comprising nucleotide sequences encoding one or more of a KAR2 polypeptide, a PDI1 polypeptide, an ERO1 polypeptide, or an IRE1 polypeptide. In certain such embodiments, the modified host cell comprises one or more heterologous nucleic acids comprising a nucleotide sequence encoding the KAR2 polypeptide, one or more heterologous nucleic acids comprising a nucleotide sequence encoding the PDI1 polypeptide, one or more heterologous nucleic acids comprising a nucleotide sequence encoding the ERO1 polypeptide, and one or more heterologous nucleic acids comprising a nucleotide sequence encoding the IRE1 polypeptide. In some embodiments, the modified host cell for expressing an engineered variant of the disclosure comprises two or more heterologous nucleic acids comprising a nucleotide sequence encoding a KAR2 polypeptide.

In some embodiments, the modified host cell for expressing an engineered variant of the disclosure comprises one or more nucleic acids comprising a nucleotide sequence encoding the engineered variant of the disclosure and comprises one or more heterologous nucleic acids comprising nucleotide sequences encoding one or more of a KAR2 polypeptide, a PDI1 polypeptide, an ERO1 polypeptide, or a FAD1 polypeptide. In certain such embodiments, the modified host cell comprises one or more heterologous nucleic acids comprising a nucleotide sequence encoding the KAR2 polypeptide, one or more heterologous nucleic acids comprising a nucleotide sequence encoding the PDI1 polypeptide, one or more heterologous nucleic acids comprising a nucleotide sequence encoding the ERO1 polypeptide, and one or more heterologous nucleic acids comprising a nucleotide sequence encoding the FAD1 polypeptide. In some embodiments, the modified host cell for expressing an engineered variant of the disclosure comprises two or more heterologous nucleic acids comprising a nucleotide sequence encoding a KAR2 polypeptide.

In some embodiments, the modified host cell for expressing an engineered variant of the disclosure comprising one or more nucleic acids comprising a nucleotide sequence encoding an engineered variant of the disclosure comprises a deletion or downregulation of one or more genes encoding one or more of a ROT2 polypeptide or a PEP4 polypeptide. In certain such embodiments, the modified host cell comprises a deletion or downregulation of one or more genes encoding the ROT2 polypeptide and the PEP4 polypeptide. The disclosure provides a method of making a modified host cell for expressing an engineered variant of the disclosure, the method comprising introducing into a host cell: a) one or more nucleic acids comprising a nucleotide sequence encoding an engineered variant of the disclosure and b) a deletion or downregulation of one or more genes encoding one or more of a ROT2 polypeptide or a PEP4 polypeptide.

In some embodiments, the modified host cell for expressing an engineered variant of the disclosure comprises one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or an IRE1 polypeptide, and a deletion or downregulation of one or more genes encoding one or more of a ROT2 polypeptide or a PEP4 polypeptide. In certain such embodiments, the modified host cell comprises one or more heterologous nucleic acids comprising a nucleotide sequence encoding the KAR2 polypeptide, one or more heterologous nucleic acids comprising a nucleotide sequence encoding the PDI1 polypeptide, one or more heterologous nucleic acids comprising a nucleotide sequence encoding the ERO1 polypeptide, and one or more heterologous nucleic acids comprising a nucleotide sequence encoding the IRE1 polypeptide and a deletion or downregulation of one or more genes encoding the ROT2 polypeptide and the PEP4 polypeptide. In some embodiments, the modified host cell for expressing an engineered variant of the disclosure comprises two or more heterologous nucleic acids comprising a nucleotide sequence encoding a KAR2 polypeptide.

The disclosure provides a method of making a modified host cell for expressing an engineered variant of the disclosure, the method comprising introducing into a host cell: a) one or more nucleic acids comprising a nucleotide sequence encoding an engineered variant of the disclosure, b) one or more heterologous nucleic acids comprising nucleotide sequences encoding one or more of a KAR2 polypeptide, a PDI1 polypeptide, an ERO1 polypeptide, or an IRE1 polypeptide, and c) a deletion or downregulation of one or more genes encoding one or more of a ROT2 polypeptide or a PEP4 polypeptide.

The disclosure provides a method of making a modified host cell for expressing an engineered variant of the disclosure, the method comprising introducing into a host cell: a) one or more nucleic acids comprising a nucleotide sequence encoding an engineered variant of the disclosure and b) one or more heterologous nucleic acids comprising nucleotide sequences encoding one or more of a KAR2 polypeptide, a PDI1 polypeptide, an ERO1 polypeptide, or a FAD1 polypeptide.

In some embodiments, the modified host cell for expressing an engineered variant of the disclosure may comprise one or more nucleic acids comprising a nucleotide sequence encoding an engineered variant of the disclosure and express or overexpress combinations of heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In some embodiments, the methods of making a modified host cell for expressing an engineered variant of the disclosure comprise introducing into a host cell one or more heterologous nucleic acids comprising nucleotide sequences encoding one or more polypeptides involved in cannabinoid or cannabinoid precursor biosynthesis. In some embodiments disclosed herein, the nucleotide sequences encoding the one or more polypeptides involved in cannabinoid or cannabinoid precursor biosynthesis are codon-optimized.

In some embodiments, the modified host cell for expressing an engineered variant of the disclosure comprises one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or an IRE1 polypeptide, a deletion or downregulation of one or more genes encoding one or more of a ROT2 polypeptide or a PEP4 polypeptide, and one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In certain such embodiments, the modified host cell comprises one or more heterologous nucleic acids comprising a nucleotide sequence encoding the KAR2 polypeptide, one or more heterologous nucleic acids comprising a nucleotide sequence encoding the PDI1 polypeptide, one or more heterologous nucleic acids comprising a nucleotide sequence encoding the ERO1 polypeptide, one or more heterologous nucleic acids comprising a nucleotide sequence encoding the IRE1 polypeptide and a deletion or downregulation of the genes encoding the ROT2 polypeptide and the PEP4 polypeptide. In some embodiments, the modified host cell for expressing an engineered variant of the disclosure comprises two or more heterologous nucleic acids comprising a nucleotide sequence encoding a KAR2 polypeptide.

In some embodiments, the modified host cell for expressing an engineered variant of the disclosure comprises one or more nucleic acids comprising a nucleotide sequence encoding an engineered variant of the disclosure, one or more heterologous nucleic acids comprising nucleotide sequences encoding one or more of a KAR2 polypeptide, a PDI1 polypeptide, an ERO1 polypeptide, or a FAD1 polypeptide and one or more heterologous nucleic acids comprising nucleotide sequences encoding one or more polypeptides involved in cannabinoid or cannabinoid precursor (e.g., geranylpyrophosphate (GPP), prenyl phosphates, olivetolic acid, or hexanoyl-CoA) biosynthesis. In certain such embodiments, the modified host cell comprises one or more heterologous nucleic acids comprising a nucleotide sequence encoding the KAR2 polypeptide, one or more heterologous nucleic acids comprising a nucleotide sequence encoding the PDI1 polypeptide, one or more heterologous nucleic acids comprising a nucleotide sequence encoding the ERO1 polypeptide, one or more heterologous nucleic acids comprising a nucleotide sequence encoding the FAD1 polypeptide. In some embodiments, the modified host cell for expressing an engineered variant of the disclosure comprises two or more heterologous nucleic acids comprising a nucleotide sequence encoding a KAR2 polypeptide.

To modify a parent host cell to produce a modified host cell of the present disclosure, one or more nucleic acids (e.g., heterologous) disclosed herein may be introduced stably or transiently into a host cell, using established techniques. Such techniques may include, but are not limited to, electroporation, calcium phosphate precipitation, DEAE-dextran mediated transfection, liposome-mediated transfection, the lithium acetate method, and the like. See Gietz, R. D. and R. A. Woods. (2002) TRANSFORMATION OF YEAST BY THE Liac/SS CARRIER DNA/PEG METHOD. For stable transformation, a plasmid, vector, expression construct, etc. comprising one or more nucleic acids (e.g., heterologous) disclosed herein will generally further include a selectable marker, e.g., any of several well-known selectable markers such as neomycin resistance, ampicillin resistance, tetracycline resistance, chloramphenicol resistance, kanamycin resistance, and the like. In some embodiments, the selectable marker gene to provide a phenotypic trait for selection of transformed host cells is dihydrofolate reductase. In some embodiments, a parent host cell is modified to produce a modified host cell of the present disclosure using a CRISPR/Cas9 system to modify a parent host cell with one or more nucleic acids (e.g., heterologous) disclosed herein.

In some embodiments, varying polypeptide expression level, such as engineered variant expression level, and/or the production of cannabinoids or cannabinoid derivatives in a modified host cell may be done by changing the gene copy number, promoter strength, and/or promoter regulation and/or by codon-optimization.

One or more nucleic acids (e.g., heterologous) disclosed herein, such as one or more nucleic acids comprising a nucleotide sequence encoding an engineered variant of the disclosure, can be present in an expression vector or construct. Suitable expression vectors may include, but are not limited to, plasmids, yeast plasmids, yeast artificial chromosomes, and any other vectors specific for specific hosts of interest (such as yeast). Thus, for example, one or more nucleic acids (e.g., heterologous) comprising nucleotide sequences encoding a mevalonate pathway gene product(s) is included in any one of a variety of expression vectors for expressing the mevalonate pathway gene product(s). Such vectors may include chromosomal, non-chromosomal, and synthetic DNA sequences.

The present disclosure provides for a method of making a modified host cell of the disclosure, the method comprising introducing into a host cell one or more vectors disclosed herein.

The present disclosure provides for a method of making a modified host cell for producing a cannabinoid or a cannabinoid derivative, the method comprising introducing into a host cell one or more vectors disclosed herein. In certain such embodiments, the one or more vectors comprise one or more vectors comprising one or more nucleic acids (e.g., heterologous) comprising a nucleotide sequence encoding an engineered variant of the disclosure. In certain such embodiments, the one or more vectors comprise one or more vectors comprising one or more nucleic acids (e.g., heterologous) comprising nucleotide sequences encoding one or more secretory pathway polypeptides. In some embodiments, the method comprises introducing into the host cell a deletion or downregulation of one or more genes encoding one or more secretory pathway polypeptides. In some embodiments, the nucleotide sequences encoding the one or more secretory pathway polypeptides are codon-optimized. In some embodiments, the one or more vectors comprise one or more vectors comprising one or more nucleic acids (e.g., heterologous) comprising nucleotide sequences encoding one or more polypeptides involved in cannabinoid or cannabinoid precursor biosynthesis. In some embodiments, the nucleotide sequences encoding the one or more polypeptides involved in cannabinoid or cannabinoid precursor biosynthesis are codon-optimized.

The present disclosure provides for a method of making a modified host cell for expressing a cannabinoid synthase polypeptide, the method comprising introducing into a host cell one or more vectors disclosed herein. In certain such embodiments, the one or more vectors comprise one or more vectors comprising one or more nucleic acids (e.g., heterologous) comprising a nucleotide sequence encoding an engineered variant of the disclosure. In certain such embodiments, the one or more vectors comprise one or more vectors comprising one or more nucleic acids (e.g., heterologous) comprising nucleotide sequences encoding one or more secretory pathway polypeptides. In some embodiments, the nucleotide sequences encoding the one or more secretory pathway polypeptides are codon-optimized. In some embodiments, the method comprises introducing into the host cell a deletion or downregulation of one or more genes encoding one or more secretory pathway polypeptides. In some embodiments, the one or more vectors comprise one or more vectors comprising one or more nucleic acids (e.g., heterologous) comprising nucleotide sequences encoding one or more polypeptides involved in cannabinoid or cannabinoid precursor biosynthesis. In some embodiments, the nucleotide sequences encoding the one or more polypeptides involved in cannabinoid or cannabinoid precursor biosynthesis are codon-optimized.

Numerous additional suitable expression vectors are known to those of skill in the art, and many are commercially available. The following vectors are provided by way of example; for yeast, the low copy CEN ARS and high copy 2 micron plasmids. However, any other plasmid or other vector may be used so long as it is compatible with the host cell.

In some embodiments, one or more of the nucleic acids (e.g., heterologous) disclosed herein are present in a single expression vector. In some embodiments, two or more of the nucleic acids (e.g., heterologous) disclosed herein are present in a single expression vector. In some embodiments, three or more of the nucleic acids (e.g., heterologous) disclosed herein are present in a single expression vector. In some embodiments, four or more of the nucleic acids (e.g., heterologous) disclosed herein are present in a single expression vector. In some embodiments, five or more of the nucleic acids (e.g., heterologous) disclosed herein are present in a single expression vector. In some embodiments, six or more of the nucleic acids (e.g., heterologous) disclosed herein are present in a single expression vector. In some embodiments, seven or more of the nucleic acids (e.g., heterologous) disclosed herein are present in a single expression vector.

In some embodiments, two or more nucleic acids (e.g., heterologous) disclosed herein are in separate expression vectors. In some embodiments, three or more nucleic acids (e.g., heterologous) disclosed herein are in separate expression vectors. In some embodiments, four or more nucleic acids (e.g., heterologous) disclosed herein are in separate expression vectors. In some embodiments, five or more nucleic acids (e.g., heterologous) disclosed herein are in separate expression vectors. In some embodiments, six or more nucleic acids (e.g., heterologous) disclosed herein are in separate expression vectors. In some embodiments, seven or more nucleic acids (e.g., heterologous) disclosed herein are in separate expression vectors. In some embodiments, eight or more nucleic acids (e.g., heterologous) disclosed herein are in separate expression vectors. In some embodiments, nine or more nucleic acids (e.g., heterologous) disclosed herein are in separate expression vectors. In some embodiments, ten or more nucleic acids (e.g., heterologous) disclosed herein are in separate expression vectors.

In some embodiments, one or more of the nucleic acids (e.g., heterologous) disclosed herein are present in a single expression construct. In some embodiments, two or more of the nucleic acids (e.g., heterologous) disclosed herein are present in a single expression construct. In some embodiments, three or more of the nucleic acids (e.g., heterologous) disclosed herein are present in a single expression construct. In some embodiments, four or more of the nucleic acids (e.g., heterologous) disclosed herein are present in a single expression construct. In some embodiments, five or more of the nucleic acids (e.g., heterologous) disclosed herein are present in a single expression construct. In some embodiments, six or more of the nucleic acids (e.g., heterologous) disclosed herein are present in a single expression construct. In some embodiments, seven or more of the nucleic acids (e.g., heterologous) disclosed herein are present in a single expression construct.

In some embodiments, two or more nucleic acids (e.g., heterologous) disclosed herein are in separate expression constructs. In some embodiments, three or more nucleic acids (e.g., heterologous) disclosed herein are in separate expression constructs. In some embodiments, four or more nucleic acids (e.g., heterologous) disclosed herein are in separate expression constructs. In some embodiments, five or more nucleic acids (e.g., heterologous) disclosed herein are in separate expression constructs. In some embodiments, six or more nucleic acids (e.g., heterologous) disclosed herein are in separate expression constructs. In some embodiments, seven or more nucleic acids (e.g., heterologous) disclosed herein are in separate expression constructs. In some embodiments, eight or more nucleic acids (e.g., heterologous) disclosed herein are in separate expression constructs. In some embodiments, nine or more nucleic acids (e.g., heterologous) disclosed herein are in separate expression constructs. In some embodiments, ten or more nucleic acids (e.g., heterologous) disclosed herein are in separate expression constructs.

In some embodiments, one or more of the nucleic acids (e.g., heterologous) disclosed herein is present in a high copy number plasmid, e.g., a plasmid that exists in about 10-50 copies per cell, or more than 50 copies per cell. In some embodiments, one or more of the nucleic acids (e.g., heterologous) disclosed herein is present in a low copy number plasmid. In some embodiments, one or more of the nucleic acids (e.g., heterologous) disclosed herein is present in a medium copy number plasmid. The copy number of the plasmid may be selected to reduce expression of one or more polypeptides disclosed herein, such as an engineered variant of the disclosure. Reducing expression by limiting the copy number of the plasmid may prevent saturation of the secretory pathway leading to possible protein degradation and/or modified host cell death or a loss of modified host cell viability.

In some embodiments, the modified host cell has one copy of a nucleic acid (e.g., heterologous) comprising a nucleotide sequence encoding a polypeptide disclosed herein. In some embodiments, the modified host cell has two copies of a nucleic acid (e.g., heterologous) comprising a nucleotide sequence encoding a polypeptide disclosed herein. In some embodiments, the modified host cell has three copies of a nucleic acid (e.g., heterologous) comprising a nucleotide sequence encoding a polypeptide disclosed herein. In some embodiments, the modified host cell has four copies of a nucleic acid (e.g., heterologous) comprising a nucleotide sequence encoding a polypeptide disclosed herein. In some embodiments, the modified host cell has five copies of a nucleic acid (e.g., heterologous) comprising a nucleotide sequence encoding a polypeptide disclosed herein. In some embodiments, the modified host cell has six copies of a nucleic acid (e.g., heterologous) comprising a nucleotide sequence encoding a polypeptide disclosed herein. In some embodiments, the modified host cell has seven copies of a nucleic acid (e.g., heterologous) comprising a nucleotide sequence encoding a polypeptide disclosed herein. In some embodiments, the modified host cell has eight copies of a nucleic acid (e.g., heterologous) comprising a nucleotide sequence encoding a polypeptide disclosed herein. In some embodiments, the modified host cell has nine copies of a nucleic acid (e.g., heterologous) comprising a nucleotide sequence encoding a polypeptide disclosed herein. In some embodiments, the modified host cell has ten copies of a nucleic acid (e.g., heterologous) comprising a nucleotide sequence encoding a polypeptide disclosed herein. In some embodiments, the modified host cell has eleven copies of a nucleic acid (e.g., heterologous) comprising a nucleotide sequence encoding a polypeptide disclosed herein. In some embodiments, the modified host cell has twelve copies of a nucleic acid (e.g., heterologous) comprising a nucleotide sequence encoding a polypeptide disclosed herein. In some embodiments, the modified host cell has twelve or more copies of a nucleic acid (e.g., heterologous) comprising a nucleotide sequence encoding a polypeptide disclosed herein.

Depending on the host/vector or host/construct system utilized, any of a number of suitable transcription and translation control elements, including constitutive and inducible promoters, transcription enhancer elements, transcription terminators, etc. may be used in the expression vector or construct (see e.g., Bitter et al. (1987)*Methods in Enzymology,* 153:516-544).

In some embodiments, the nucleic acids (e.g., heterologous) disclosed herein are operably linked to a promoter. In some embodiments, the promoter is a constitutive promoter. In some embodiments, the promoter is an inducible promoter. In some embodiments, the promoter is functional in a eukaryotic cell. In some embodiments, the promoter can be a strong driver of expression. In some embodiments, the promoter can be a weak driver of expression. In some embodiments, the promoter can be a medium driver of expression. The promoter may be selected to reduce expression of one or more polypeptides disclosed herein, such as an engineered variant of the disclosure. Reducing expression through promoter selection may prevent saturation of the secretory pathway leading to possible protein degradation and/or modified host cell death or a loss of modified host cell viability. Examples of strong constitutive promoters include, but are not limited to: pTDH3 and pFBA1. Examples of medium constitutive promoters include, but are not limited to: pACT1 and pCYC1. An example of a weak constitutive promoter includes, but is not limited to: pSLN1. Examples of strong inducible promoters include, but are not limited to: pGAL1 and pGAL10. An example of a medium inducible promoter includes, but is not limited to: pGAL7. An example of a weak inducible promoter includes, but is not limited to: pGAL3.

Non-limiting examples of suitable eukaryotic promoters may include CMV immediate early, HSV thymidine kinase, early and late SV40, LTRs from retrovirus, and mouse metallothionein-I. Selection of the appropriate vector, construct, and promoter is well within the level of ordinary skill in the art. The expression vector or construct may also contain a ribosome binding site for translation initiation and a transcription terminator. The expression vector or construct may also include appropriate sequences for amplifying expression.

Inducible promoters are well known in the art. Suitable inducible promoters may include, but are not limited to, a tetracycline-inducible promoter; an estradiol inducible promoter, a sugar inducible promoter, e.g., pGal1 or pSUC2, an amino acid inducible promoter, e.g., pMet25; a metal inducible promoter, e.g., pCup1, a methanol-inducible promoter, e.g., pAOX1, and the like.

In yeast, a number of vectors or constructs containing constitutive or inducible promoters may be used. For a review see, Current Protocols in Molecular Biology, Vol. 2, 1988, Ed. Ausubel, et al., Greene Publish. Assoc. & Wiley Interscience, Ch. 13; Grant, et al., 1987, Expression and Secretion Vectors for Yeast, in Methods in Enzymology, Eds. Wu & Grossman, 31987, Acad. Press, N.Y., Vol. 153, pp. 516-544; Glover, 1986, DNA Cloning, Vol. II, IRL Press, Wash., D.C., Ch. 3; and Bitter, 1987, Heterologous Gene Expression in Yeast, Methods in Enzymology, Eds. Berger & Kimmel, Acad. Press, N.Y., Vol. 152, pp. 673-684; and The Molecular Biology of the Yeast *Saccharomyces,* 1982, Eds. Strathern et al., Cold Spring Harbor Press, Vols. I and II. A constitutive yeast promoter such as pADH, pTDH3, pFBA1, pACT1, pCYC1, and pSLN1 or an inducible promoter such as pGAL1, pGAL10, pGAL7, and pGAL3 may be used (Cloning in Yeast, Ch. 3, R. Rothstein In: DNA Cloning Vol. 11, A Practical Approach, Ed. D M Glover, 1986, IRL Press, Wash., D.C.). Alternatively, vectors may be used which promote integration of foreign DNA sequences into the yeast chromosome. Generally, recombinant expression vectors will include origins of replication and selectable markers permitting transformation of the host cell, e.g., the *S. cerevisiae* TRP1 gene or a gene cassette encoding resistance to an antibiotic, etc.; and a promoter derived from a highly-expressed gene to direct transcription of the coding sequence. Such promoters can be derived from genetic sequences encoding glycolytic enzymes such as 3-phosphoglycerate kinase (PGK), α-factor, acid phosphatase, or heat shock proteins, among others.

In some embodiments, one or more nucleic acids (e.g., heterologous) disclosed herein is integrated into the genome of the modified host cell disclosed herein. In some embodiments, one or more nucleic acids (e.g., heterologous) disclosed herein is integrated into a chromosome of the modified host cell disclosed herein. In some embodiments, one or more nucleic acids (e.g., heterologous) disclosed herein remains episomal (i.e., is not integrated into the genome or a chromosome of the modified host cell). In some embodiments, at least one of the one or more nucleic acids (e.g., heterologous) disclosed herein is maintained extrachromosomally (e.g., on a plasmid or artificial chromosome). The gene copy number of one or more genes encoding one or more polypeptides disclosed herein, such as an engineered variant of the disclosure, may be selected to reduce expression of the one or more polypeptides disclosed herein, such as an engineered variant of the disclosure. Reducing expression by limiting the gene copy number may prevent saturation of the secretory pathway leading to possible protein degradation and/or modified host cell death or a loss of modified host cell viability.

As will be appreciated by the skilled artisan, slight changes in nucleotide sequence do not necessarily alter the amino acid sequence of the encoded polypeptide. It will be appreciated by persons skilled in the art that changes in the identities of nucleotides in a specific gene sequence that change the amino acid sequence of the encoded polypeptide may result in reduced or enhanced effectiveness of the genes and that, in some applications (e.g., anti-sense, co-suppression, or RNAi), partial sequences often work as effectively as full length versions. The ways in which the nucleotide sequence can be varied or shortened are well known to persons skilled in the art, as are ways of testing the effectiveness of the altered genes. In certain embodiments, effectiveness may easily be tested by, for example, conventional gas chromatography. All such variations of the genes are therefore included as part of the present disclosure.

Genomic deletion of the open reading frame encoding the protein may abolish all expression of a gene. Downregulation of a gene can be accomplished in several ways at the DNA, RNA, or protein level, with the result being a reduction in the amount of active protein in the cell. Truncations of the open reading frame or the introduction of mutations that destabilize the protein or reduce catalytic activity achieve a similar goal, as does fusing a "degron" polypeptide that destabilizes the protein. Engineering of the regulatory regions of the gene can also be used to change gene expression. Alteration of the promoter sequence or replacement with a different promoter is one method. Truncation of the terminator, known as decreased abundance of mRNA perturbation (DAmP), is also known to reduce gene expression. Other methods that reduce the stability of the mRNA include the use of cis- or trans-acting ribozymes, e.g., self-cleaving ribozymes, or RNA elements that recruit an exonuclease, or antisense DNA. RNAi may be used to silence genes in budding yeast strains via import of the required protein factors from other species, e.g., Drosha or Dice (Drinnenberg et al 2009). Gene expression may also be silenced in *S. cerevisiae* via recruitment of native or heterologous silencing factors or repressors, which may be accomplished at arbitrary loci using the D-Cas9 CRISPR system (Qi et al 2013). Protein level can also be reduced by engineering the amino acid sequence of the target protein. A variety of degron sequences may be used to target the protein for rapid degradation, including, but not limited to, ubiquitin fusions and N-end rule residues at the amino terminus. These methods may be implemented in a constitutive or conditional fashion.

Induction Systems

To adapt to a constantly changing environment, microbes such as yeast have evolved a wide range of natural inducible promoter systems. Any promoter that is regulated by a small molecule or change in environment (temperature, pH, oxygen level, osmolarity, oxidative damage) can in principle be converted into an inducible system for the expression of heterologous genes. The best known system in *S. cerevisiae* is the galactose regulon, which is strongly repressed by glucose and activated by galactose. Heterologous genetic pathways under the control of galactose-inducible promoters are regulated in the same way, and thus an engineered strain can be grown in glucose media to build biomass, and then switched to galactose to induce pathway expression. A range of expression levels can be achieved, from very strong pGAL1 to relatively weak pGAL3. However, galactose may be expensive and a poor carbon source for *S. cerevisiae*. Therefore, for industrial applications, it may be advantageous to re-engineer the regulon such that the cells can be induced in a non-galactose media. The galactose regulon can be modified for this purpose in many ways, including:

- Overexpressing the negative regulator of GAL80, GAL3, from an inducible promoter, e.g., pSUC2-GAL3, such that switching from glucose to sucrose relieves GAL80 expression and activates the pathway.
- Deleting the repressor GAL80 and replacing the native GAL4 cassette with a version under the control of a sucrose inducible promoter, e.g., pSUC2-GAL4, such that expression is induced by a switch from glucose to sucrose.
- Replacing the native GAL80 gene with an inducible version, e.g., pSUC2-GAL80, such that expression is induced by a switch from sucrose to glucose.

These strategies often require fine-tuning of the activator and repressor levels to achieve the proper dynamics (very low or no expression in the off state, and desired expression level in the on state). There are a variety of ways to fine tune protein expression, including use of protein stabilization or degradation tags (e.g., degrons) or use of temperature sensitive mutants of the activators or regulators. In the examples above, the pSUC2 promoter is used to induce the galactose regulon in sucrose media. However, any inducible promoter can be used for this purpose, or for control of individual genes outside of the context of the galactose regulon. The list below provides some examples:

- Phosphate regulated promoters, e.g., pPHO5
- Carbon source regulated promoters, e.g., pADH2
- Amino acid regulated promoters, e.g., pMET25
- Metal ion induced promoters, e.g., pCUP1
- Temperature regulated promoters, e.g., pHSP12, pHSP26
- pH regulated promoters, e.g., pHSP12, pHSP26
- Oxygen level regulated promoters, e.g., pDAN1
- Oxidative stress regulated promoters, e.g., AHP1, TRR1, TRX2, TSA1, GPX2, GSH1, GSH2, GLR1, SOD1, or SOD2 genes.
- ER stress regulated promoters, e.g., unfolded protein response element promoters.

In addition to these natural examples, there are a variety of synthetic inducible promoter systems. These are generally based on re-arrangement of native or foreign transcriptional elements into a basal promoter scaffold and/or fusions of activator domains and DNA binding domains to create novel transcription factors. Two examples are provided below:

- Estradiol-inducible systems involving fusion of the estradiol receptor to DNA-binding and transcriptional activation domain, paired with synthetic or native promoters with binding sites.
- tet Trans Activator (tTA) or reverse tet Trans Activator (rtTA) systems paired with tetO-containing promoters.

In some embodiments, one of the above inducible promoter systems is used in a modified host cell of the disclosure. In some embodiments, the inducible promoter system is a natural inducible promoter system. In some embodiments, the inducible promoter system is a synthetic inducible promoter system. In some embodiments, a suitable media for culturing modified host cells of the disclosure comprises one or more of the inducers disclosed herein. Possible inducers include:

- Phosphate regulated promoters, e.g., pPHO5
  - $KH_2PO_4$
- Carbon source regulated promoters, e.g., pADH2
  - Galactose (e.g., pGAL1)
  - Glucose (e.g., pADH2)
  - Sucrose (e.g., pSUC2, pGPH1, pMAL12)
  - Maltose (e.g., pMAL12, pMAL32)
- Amino acid regulated promoters, e.g., pMET25
  - Methionine (e.g., pMET25)
  - Lysine (e.g., pLYS9)
  - Other amino acids
- Metal ion induced promoters, e.g., pCUP1
  - $CuSO_4$
- Temperature regulated promoters, e.g., pHSP12, pHSP26
  - Change in temperature, e.g., 30° C. to 37° C.
- pH regulated promoters, e.g., pHSP12, pHSP26
  - Change in pH, e.g., pH 6 to pH 4
- Oxygen level regulated promoters, e.g., pDAN1
  - Change in oxygen level, e.g., 20% to 1% dissolved oxygen levels
- Oxidative stress regulated promoters, e.g., pSOD1
  - Addition of hydrogen peroxide or superoxide-generating drug menadione
- ER stress regulated promoters, e.g., unfolded protein response element promoters.
  - Tunicamycin, or expression of proteins prone to misfolding (e.g., cannabinoid synthases)
- Estradiol-inducible systems involving fusion of the estradiol receptor to DNA-binding and transcriptional activation domain, paired with synthetic or native promoters with binding sites.
  - Estradiol
- tet Trans Activator (tTA) or reverse tet Trans Activator (rtTA) systems paired with tetO-containing promoters.
  - Doxycyclin Codon Usage As is well known to those of skill in the art, it is possible to improve the expression of a heterologous nucleic acid in a host organism by replacing the nucleotide sequences coding for a particular amino acid (i.e., a codon) with another codon which is better expressed in the host organism (i.e., codon-optimization). One reason that this effect arises is due to the fact that different organisms show preferences for different codons. In some embodiments, a nucleic acid disclosed herein is modified or optimized such that the nucleotide sequence reflects the codon preference for the particular host cell. For example, the nucleotide sequence will in some embodiments be modified or optimized for yeast codon preference. In some embodiments, a nucleotide sequence disclosed herein is codon-optimized. See, e.g., Bennetzen and Hall (1982) *J. Biol. Chem.* 257(6): 3026-3031.

Statistical methods have been generated to analyze codon usage bias in various organisms and many computer algorithms have been developed to implement these statistical analyses in the design of codon optimized gene sequences (Lithwick G, Margalit H (2003) Hierarchy of sequence-dependent features associated with prokaryotic translation. Genome Research 13: 2665-73). Other modifications in codon usage to increase protein expression that are not dependent on codon bias have also been described (Welch et al. (2009). In some embodiments, codon optimization of the nucleotide sequence may result in an increase in the desired polypeptide or enzyme catalytic activity in the modified host cell.

In some embodiments, the codon usage of a nucleotide sequence is modified or optimized such that the level of translation of the encoded mRNA is decreased. In some embodiments, a codon-optimized nucleotide sequence may be optimized such that the level of translation of the encoded mRNA is decreased. Reducing the level of translation of an mRNA by modifying codon usage may be achieved by modifying the nucleotide sequence to include codons that are rare or not commonly used by the host cell. Codon usage tables for many organisms are available that summarize the percentage of time a specific organism uses a specific codon to encode for an amino acid. Certain codons are used more often than other, “rare” codons. The use of “rare” codons in a nucleotide sequence generally decreases its rate of translation. Thus, e.g., the nucleotide sequence is modified by introducing one or more rare codons, which affect the rate of translation, but not the amino acid sequence of the polypeptide translated. For example, there are six codons that encode for arginine: CGT, CGC, CGA, CGG, AGA, and AGG. In *E. coli* the codons CGT and CGC are used far more often (encoding approximately 40% of the arginines in *E. coli* each) than the codon AGG (encoding approximately 2% of the arginines in *E. coli*). Modifying a CGT codon within the sequence of a gene to an AGG codon would not change the sequence of the polypeptide, but would likely decrease the gene’s rate of translation.

In some embodiments, a codon-optimized nucleotide sequence may be optimized for expression in a yeast cell. In certain such embodiments, the yeast cell is *Saccharomyces cerevisiae.*

Further, it will be appreciated that this disclosure embraces the degeneracy of codon usage as would be understood by one of ordinary skill in the art and illustrated in the following table.

Codon Degeneracies

| Amino Acid | Codons |
|---|---|
| Ala/A | GCT, GCC, GCA, GCG |
| Arg/R | CGT, CGC, CGA, CGG, AGA, AGG |
| Asn/N | AAT, AAC |
| Asp/D | GAT, GAC |
| Cys/C | TGT, TGC |
| Gln/Q | CAA, CAG |
| Glu/E | GAA, GAG |
| Gly/G | GGT, GGC, GGA, GGG |
| His/H | CAT, CAC |
| Ile/I | ATT, ATC, ATA |
| Leu/L | TTA, TTG, CTT, CTC, CTA, CTG |
| Lys/K | AAA, AAG |
| Met/M | ATG |
| Phe/F | TTT, TTC |
| Pro/P | CCT, CCC, CCA, CCG |
| Ser/S | TCT, TCC, TCA, TCG, AGT, AGC |
| Thr/T | ACT, ACC, ACA, ACG |
| Trp/W | TGG |
| Tyr/Y | TAT, TAC |
| Val/V | GTT, GTC, GTA, GTG |
| START | ATG |
| STOP | TAG, TGA, TAA |

Methods of Producing a Cannabinoid or a Cannabinoid Derivative or of Expressing and/or Preparing Engineered Variants of the Cannabidiolic Acid Synthase (CBDAS) Polypeptide The disclosure provides methods for expressing an engineered variant of the cannabidiolic acid synthase (CBDAS) polypeptide of the disclosure. In certain such embodiments, the methods comprise culturing a modified host cell of the disclosure in a culture medium. The disclosure also provides methods for preparing an engineered variant of the cannabidiolic acid synthase (CBDAS) polypeptide of the disclosure. The disclosure also provides methods of producing a cannabinoid or a cannabinoid derivative, the method comprising use of an engineered variant of the disclosure.

The present disclosure also provides methods of producing a cannabinoid or a cannabinoid derivative. The methods of the present disclosure may involve production of cannabinoids or cannabinoid derivatives using an engineered variant disclosed herein. The methods may involve culturing a modified host cell of the present disclosure in a culture medium and recovering the produced cannabinoid or cannabinoid derivative. The methods may also involve cell-free production of cannabinoids or cannabinoid derivatives using one or more polypeptides disclosed herein, such as an engineered variant of the disclosure, expressed or overexpressed by a modified host cell of the disclosure. The methods may also involve cell-free production of cannabinoids or cannabinoid derivatives using an engineered variant disclosed herein.

Cannabinoids or cannabinoid derivatives that can be produced with the engineered variants, methods, or modified host cells of the present disclosure may include, but are not limited to, cannabichromene (CBC) type (e.g., cannabichromenic acid), cannabidiol (CBD) type (e.g., cannabidiolic acid), $\Delta^9$-trans-tetrahydrocannabinol ($\Delta^9$-THC) type (e.g., $\Delta^9$-tetrahydrocannabinolic acid), $\Delta^8$-trans-tetrahydrocannabinol ($\Delta^8$-THC) type, cannabicyclol (CBL) type, cannabielsoin (CBE) type, cannabinol (CBN) type, cannabinodiol (CBND) type, cannabitriol (CBT) type, derivatives of any of the foregoing, and others as listed in Elsohly M. A. and Slade D., Life Sci. 2005 Dec. 22; 78(5):539-48. Epub 2005 Sep. 30. In some embodiments, the cannabinoid or cannabinoid derivative is produced in an amount of more than 100 mg/L culture medium. In some embodiments, the cannabinoid or cannabinoid derivative is produced in an amount of more than 50 mg/L culture medium.

Cannabinoids or cannabinoid derivatives that can be produced with the engineered variants, methods, or modified host cells of the present disclosure may also include, but are not limited to, cannabichromenic acid (CBCA), cannabichromene (CBC), cannabichromevarinic acid (CBCVA), cannabichromevarin (CBCV), CBDA, cannabidiol (CBD), cannabidiol monomethylether (CBDM), cannabidiol-C4 (CBD-C4), cannabidivarinic acid (CBDVA), cannabidivarin (CBDV), cannabidiorcol (CBD-$C_1$), $\Delta^9$-tetrahydrocannabinolic acid A (THCA-A), $\Delta^9$-tetrahydrocannabinolic acid B (THCA-B), $\Delta^9$-tetrahydrocannabinol (THC), $\Delta^9$-tetrahydrocannabinolic acid-C4 (THCA-C4), $\Delta^9$-tetrahydrocannabinol-C4 (THC-C4), $\Delta^9$-tetrahydrocannabivarinic acid (THCVA), $\Delta^9$-tetrahydrocannabivarin (THCV), $\Delta^9$-tetrahydrocannabiorcolic acid (THCA-$C_1$), $\Delta^9$-tetrahydrocannabiorcol (THC-$C_1$), $\Delta^7$-cis-iso-tetrahydrocannabivarin, $\Delta^8$-tetrahydrocannabinolic acid ($\Delta^8$-THCA), $\Delta^8$-tetrahydrocannabinol ($\Delta^8$-THC), cannabicyclolic acid (CBLA), cannabicyclol (CBL), cannabicyclovarin (CBLV), cannabielsoic acid A (CBEA-A), cannabielsoic acid B (CBEA-B), cannabielsoin (CBE), cannabielsoinic acid, cannabicitranic acid, cannabinolic acid (CBNA), cannabinol (CBN), cannabinol methylether (CBNM), cannabinol-C4, (CBN-C4), cannabivarin (CBV), cannabinol-C2 (CNB-C2), cannabiorcol (CBN-$C_1$), cannabinodiol (CBND), cannabinodivarin (CBVD), cannabitriol (CBT), 10-ethyoxy-9-hydroxy-delta-6a-tetrahydrocannabinol, 8,9-dihydroxyl-delta-6a-tetrahydrocannabinol, cannabitriolvarin (CBTVE), dehydrocannabifuran (DCBF), cannabifuran (CBF), cannabichromanon (CBCN), cannabicitran (CBT), 10-oxo-delta-6a-tetrahydrocannabinol (OTHC), delta-9-cis-tetrahydrocannabinol (cis-THC), 3,4,5,6-tetrahydro-7-hydroxy-alpha-alpha-2-trimethyl-9-n-propyl-2,6-methano-2H-1-benzoxocin-5-methanol (OH-iso-HHCV), cannabiripsol (CBR), trihydroxy-delta-9-tetrahydrocannabinol (triOH-THC), CBGA-hydrocinnamic acid (3-[(2E)-3,7-dimethylocta-2,6-dien-1-yl]-2,4-dihydroxy-6-(2-phenylethyl)benzoic acid), CBG-hydrocinnamic acid (2-[(2E)-3,7-dimethylocta-2,6-dien-1-yl]-5-(2-phenylethyl)benzene-1,3-diol), CBDA-hydrocinnamic acid (2,4-dihydroxy-3-[3-methyl-6-(prop-1-en-2-yl)cyclohex-2-en-1-yl]-6-(2-phenylethyl)benzoic acid), CBD-hydrocinnamic acid (2-[3-methyl-6-(prop-1-en-2-yl) cyclohex-2-en-1-yl]-5-(2-phenylethyl)benzene-1,3-diol), THCA-hydrocinnamic acid (1-hydroxy-6,6,9-trimethyl-3-(2-phenylethyl)-6H,6aH,7H,8H,10aH-benzo[c]isochromene-2-carboxylic acid), THC-hydrocinnamic acid (6,6,9-trimethyl-3-(2-phenylethyl)-6H,6aH,7H,8H,10aH-benzo[c]isochromen-1-ol, perrottetinene), and derivatives of any of the foregoing. In some embodiments, the cannabinoid or cannabinoid derivative is produced in an amount of more than 100 mg/L culture medium. In some embodiments, the cannabinoid or cannabinoid derivative is produced in an amount of more than 50 mg/L culture medium.

In some embodiments, the cannabinoid produced with the engineered variants, methods, or modified host cells of the present disclosure is $\Delta^9$-tetrahydrocannabinolic acid, $\Delta^9$-tetrahydrocannabinol, $\Delta^8$-tetrahydrocannabinolic acid, $\Delta^8$-tetrahydrocannabinol, cannabidiolic acid, cannabidiol, cannabichromenic acid, cannabichromene, cannabinolic acid, cannabinol, cannabidivarinic acid, cannabidivarin, tetrahydrocannabivarinic acid, tetrahydrocannabivarin, cannabichromevarinic acid, cannabichromevarin, cannabigerovarinic acid, cannabigerovarin, cannabicyclolic acid, cannabicyclol, cannabielsoinic acid, cannabielsoin, cannabicitranic acid, or cannabicitran. In some embodiments, the cannabinoid is produced in an amount of more than 100 mg/L culture medium. In some embodiments, the cannabinoid is produced in an amount of more than 50 mg/L culture medium.

In some embodiments, the cannabinoid produced with the engineered variants, methods, or modified host cells of the present disclosure is cannabidiolic acid, cannabidiol, cannabidivarinic acid, or cannabidivarin. In some embodiments, the cannabinoid is produced in an amount of more than 100 mg/L culture medium. In some embodiments, the cannabinoid is produced in an amount of more than 50 mg/L culture medium.

Additional cannabinoids and cannabinoid derivatives that can be produced with the engineered variants, methods, or modified host cells of the present disclosure may also include, but are not limited to, CBDA, CBD, CBGA, THC, THCA, THCVA, CBDVA, CBCA, CBC, (6aR,10aR)-1-hydroxy-6,6,9-trimethyl-3-butyl-6a,7,8,10a-tetrahydro-6H-dibenzo[b,d]pyran-2-carboxylic acid, (6aR,10aR)-1-hydroxy-6,6,9-trimethyl-3-(3-methylpentyl)-6a,7,8,10a-tetrahydro-6H-dibenzo[b,d]pyran-2-carboxylic acid, (6aR, 10aR)-1-hydroxy-6,6,9-trimethyl-3-(4-pentenyl)-6a,7,8, 10a-tetrahydro-6H-dibenzo[b,d]pyran-2-carboxylic acid, (6aR,10aR)-1-hydroxy-6,6,9-trimethyl-3-hexyl-6a,7,8,10a-tetrahydro-6H-dibenzo[b,d]pyran-2-carboxylic acid, (6aR, 10aR)-1-hydroxy-6,6,9-trimethyl-3-(5-hexynyl)-6a,7,8,10a-tetrahydro-6H-dibenzo[b,d]pyran-2-carboxylic acid, and others as listed in Bow, E. W. and Rimoldi, J. M., "The Structure—Function Relationships of Classical Cannabinoids: CB1/CB2 Modulation," *Perspectives in Medicinal Chemistry* 2016:8 17-39 doi: 10.4137/PMC.S32171, incorporated by reference herein. In some embodiments, the cannabinoid or cannabinoid derivative is produced in an amount of more than 100 mg/L culture medium. In some embodiments, the cannabinoid or cannabinoid derivative is produced in an amount of more than 50 mg/L culture medium.

Additional cannabinoids and cannabinoid derivatives that can be produced with the engineered variants, methods, or modified host cells of the present disclosure may also include, but are not limited to, (1'R,2'R)-4-(hexan-2-yl)-5'-methyl-2'-(prop-1-en-2-yl)-1',2',3',4'-tetrahydro-[1,1'-biphenyl]-2,6-diol, (1'R,2'R)-4-hexyl-5'-methyl-2'-(prop-1-en-2-yl)-1',2',3',4'-tetrahydro-[1,1'-biphenyl]-2,6-diol, (1'R,2'R)-5'-methyl-4-(3-methylpentyl)-2'-(prop-1-en-2-yl)-1',2',3',4'-tetrahydro-[1,1'-biphenyl]-2,6-diol, (1'R,2'R)-4-(4-chlorobutyl)-5'-methyl-2'-(prop-1-en-2-yl)-1',2',3',4'-tetrahydro-[1,1'-biphenyl]-2,6-diol, (1'R,2'R)-5'-methyl-4-(4-methylpentyl)-2'-(prop-1-en-2-yl)-1',2',3',4'-tetrahydro-[1,1'-biphenyl]-2,6-diol, (1'R,2'R)-5'-methyl-4-(4-(methylthio)butyl)-2'-(prop-1-en-2-yl)-1',2',3',4'-tetrahydro-[1,1'-biphenyl]-2,6-diol, (1'R,2'R)-5'-methyl-4-((E)-pent-1-en-1-yl)-2'-(prop-1-en-2-yl)-1',2',3',4'-tetrahydro-[1,1'-biphenyl]-2,6-diol, (1'R,2'R)-5'-methyl-4-((E)-pent-3-en-1-yl)-2'-(prop-1-en-2-yl)-1',2',3',4'-tetrahydro-[1,1'-biphenyl]-2,6-diol, (1'R,2'R)-5'-methyl-4-((E)-pent-2-en-1-yl)-2'-(prop-1-en-2-yl)-1',2',3',4'-tetrahydro-[1,1'-biphenyl]-2,6-diol, (1'R,2'R)-4-(but-3-yn-1-yl)-5'-methyl-2'-(prop-1-en-2-yl)-1',2',3',4'-tetrahydro-[1,1'-biphenyl]-2,6-diol, (1'R,2'R)-4-((E)-but-1-en-1-yl)-5'-methyl-2'-(prop-1-en-2-yl)-1',2',3',4'-tetrahydro-[1,1'-biphenyl]-2,6-diol, (1'R,2'R)-5'-methyl-4-(pent-4-yn-1-yl)-2'-(prop-1-en-2-yl)-1',2',3',4'-tetrahydro-[1,1'-biphenyl]-2,6-diol, (1'R,2'R)-5'-methyl-2'-(prop-1-en-2-yl)-4-undecyl-1',2',3',4'-tetrahydro-[1,1'-biphenyl]-2,6-diol, (1'R,2'R)-4-(hex-5-yn-1-yl)-5'-methyl-2'-(prop-1-en-2-yl)-1',2',3',4'-tetrahydro-[1,1'-biphenyl]-2,6-diol, (1'R,2'R)-4-((E)-hept-1-en-1-yl)-5'-methyl-2'-(prop-1-en-2-yl)-1',2',3',4'-tetrahydro-[1,1'-biphenyl]-2,6-diol, (1'R,2'R)-5'-methyl-4-octyl-2'-(prop-1-en-2-yl)-1',2',3',4'-tetrahydro-[1,1'-biphenyl]-2,6-diol, (1'R,2'R)-5'-methyl-4-((E)-oct-1-en-1-yl)-2'-(prop-1-en-2-yl)-1',2',3',4'-tetrahydro-[1,1'-biphenyl]-2,6-diol, (1'R,2'R)-5'-methyl-4-nonyl-2'-(prop-1-en-2-yl)-1',2',3',4'-tetrahydro-[1,1'-biphenyl]-2,6-diol, (1'R,2'R)-5'-methyl-4-(3-phenylpropyl)-2'-(prop-1-en-2-yl)-1',2',3',4'-tetrahydro-[1,1'-biphenyl]-2,6-diol, (1'R,2'R)-5'-methyl-4-(4-phenylbutyl)-2'-(prop-1-en-2-yl)-1',2',3',4'-tetrahydro-[1,1'-biphenyl]-2,6-diol, (1'R,2'R)-5'-methyl-4-(5-phenylpentyl)-2'-(prop-1-en-2-yl)-1',2',3',4'-tetrahydro-[1,1'-biphenyl]-2,6-diol, (1'R,2'R)-5'-methyl-4-(6-phenylhexyl)-2'-(prop-1-en-2-yl)-1',2',3',4'-tetrahydro-[1,1'-biphenyl]-2,6-diol, (1'R,2'R)-5'-methyl-4-(2-methylpentyl)-2'-(prop-1-en-2-yl)-1',2',3',4'-tetrahydro-[1,1'-biphenyl]-2,6-diol, (1'R,2'R)-4-isopropyl-5'-methyl-2'-(prop-1-en-2-yl)-1',2',3',4'-tetrahydro-[1,1'-biphenyl]-2,6-diol, (1'R,2'R)-4-decyl-5'-methyl-2'-(prop-1-en-2-yl)-1',2',3',4'-tetrahydro-[1,1'-biphenyl]-2,6-diol, (1'R,2'R)-5'-methyl-2'-(prop-1-en-2-yl)-4-tridecyl-1',2',3',4'-tetrahydro-[1,1'-biphenyl]-2,6-diol, (E)-3-((1'R,2'R)-2,6-dihydroxy-5'-methyl-2'-(prop-1-en-2-yl)-1',2',3',4'-tetrahydro-[1,1'-biphenyl]-4-yl)acrylic acid, (Z)-3-((1'R,2'R)-2,6-dihydroxy-5'-methyl-2'-(prop-1-en-2-yl)-1',2',3',4'-tetrahydro-[1,1'-biphenyl]-4-yl)acrylic acid, 7-((1'R,2'R)-2,6-dihydroxy-5'-methyl-2'-(prop-1-en-2-yl)-1',2',3',4'-tetrahydro-[1,1'-biphenyl]-4-yl)heptanoic acid, 8-((1'R,2'R)-2,6-dihydroxy-5'-methyl-2'-(prop-1-en-2-yl)-1',2',3',4'-tetrahydro-[1,1'-biphenyl]-4-yl)octanoic acid, 9-((1'R,2'R)-2,6-dihydroxy-5'-methyl-2'-(prop-1-en-2-yl)-1',2',3',4'-tetrahydro-[1,1'-biphenyl]-4-yl)nonanoic acid, 11-((1'R,2'R)-2,6-dihydroxy-5'-methyl-2'-(prop-1-en-2-yl)-1',2',3',4'-tetrahydro-[1,1'-biphenyl]-4-yl)undecanoic acid, (1"R,2"R)-3',5'-dihydroxy-5"-methyl-2"-(prop-1-en-2-yl)-1",2",3",4"-tetrahydro-[1,1':4',1"-terphenyl]-2-carboxylic acid, (1"R,2"R)-3',5'-dihydroxy-5"-methyl-2"-(prop-1-en-2-yl)-1",2",3",4"-tetrahydro-[1,1':4',1"-terphenyl]-3-carboxylic acid, (1"R,2"R)-3',5'-dihydroxy-5"-methyl-2"-(prop-1-en-2-yl)-1",2",3",4"-tetrahydro-[1,1':4',1"-terphenyl]-4-carboxylic acid, (1"R,2"R)-3',5'-dihydroxy-5"-methyl-2"-(prop-1-en-2-yl)-1",2",3",4"-tetrahydro-[1,1':4',1"-terphenyl]-3,5-dicarboxylic acid, (1'R,2'R)-4-(4-hydroxybutyl)-5'-methyl-2'-(prop-1-en-2-yl)-1',2',3',4'-tetrahydro-[1,1'-biphenyl]-2,6-diol, (1'R,2'R)-4-(4-aminobutyl)-5'-methyl-2'-(prop-1-en-2-yl)-1',2',3',4'-tetrahydro-[1,1'-biphenyl]-2,6-diol, 5-((1'R,2'R)-2,6-dihydroxy-5'-methyl-2'-(prop-1-en-2-yl)-1',2',3',4'-tetrahydro-[1,1'-biphenyl]-4-yl)pentanenitrile, (1'R,2'R)-5'-methyl-4-(3-methylhexan-2-yl)-2'-(prop-1-en-2-yl)-1',2',3',4'-tetrahydro-[1,1'-biphenyl]-2,6-diol, (1'R,2'R)-5'-methyl-2'-(prop-1-en-2-yl)-4-propyl-1',2',3',4'-tetrahydro-[1,1'-biphenyl]-2,6-diol, (1'R,2'R)-4-butyl-5'-methyl-2'-(prop-1-en-2-yl)-1',2',3',4'-tetrahydro-[1,1'-biphenyl]-2,6-diol, (1'R,2'R)-5'-methyl-4-pentyl-2'-(prop-1-en-2-yl)-1',2',3',4'-tetrahydro-[1,1'-biphenyl]-2,6-diol, (1'R,2'R)-4-heptyl-5'-methyl-2'-(prop-1-en-2-yl)-1',2',3',4'-tetrahydro-[1,1'-biphenyl]-2,6-diol, (1'R,2'R)-5'-methyl-4-(pent-4-en-1-yl)-2'-(prop-1-en-2-yl)-1',2',3',4'-tetrahydro-[1,1'-biphenyl]-2,6-diol, 3-((1'R,2'R)-2,6-dihydroxy-5'-methyl-2'-(prop-1-en-2-yl)-1',2',3',4'-tetrahydro-[1,1'-biphenyl]-4-yl)propanoic acid, (1'R,2'R)-4,5'-dimethyl-2'-(prop-1-en-2-yl)-1',2',3',4'-tetrahydro-[1,1'-biphenyl]-2,6-diol, 2-((1'R,2'R)-2,6-dihydroxy-5'-methyl-2'-(prop-1-en-2-yl)-1',2',3',4'-tetrahydro-[1,1'-biphenyl]-4-yl)acetic acid, 4-((1'R,2'R)-2,6-dihydroxy-5'-methyl-2'-(prop-1-en-2-yl)-1',2',3',4'-tetrahydro-[1,1'-biphenyl]-4-yl)butanoic acid, (1'R,2'R)-2,6-dihydroxy-5'-methyl-2'-(prop-1-en-2-yl)-1',2',3',4'-tetrahydro-[1,1'-biphenyl]-4-carboxylic acid, 5-((1'R,2'R)-2,6-dihydroxy-5'-methyl-2'-(prop-1-en-2-yl)-1',2',3',4'-tetrahydro-[1,1'-biphenyl]-4-yl)pentanoic acid, and 6-((1'R,2'R)-2,6-dihydroxy-5'-methyl-2'-(prop-1-en-2-yl)-1',2',3',4'-tetrahydro-[1,1'-biphenyl]-4-yl)hexanoic acid. In some embodiments, the cannabinoid or cannabinoid derivative is produced in an amount of more than 100 mg/L culture medium. In some embodiments, the cannabinoid or cannabinoid derivative is produced in an amount of more than 50 mg/L culture medium.

A cannabinoid derivative may also refer to a compound lacking one or more chemical moieties found in naturally-occurring cannabinoids, yet retains the core structural features (e.g., cyclic core) of a naturally-occurring cannabinoid. Such chemical moieties may include, but are not limited to, methyl, alkyl, alkenyl, methoxy, alkoxy, acetyl, carboxyl, carbonyl, oxo, ester, hydroxyl, and the like. In some embodiments, a cannabinoid derivative may also comprise one or more of any of the functional and/or reactive groups described herein. Functional and reactive groups may be unsubstituted or substituted with one or more functional or reactive groups.

A cannabinoid derivative may be a cannabinoid substituted with or comprising one or more functional and/or reactive groups. Functional groups may include, but are not limited to, azido, halo (e.g., chloride, bromide, iodide, fluorine), methyl, alkyl, alkynyl, alkenyl, methoxy, alkoxy, acetyl, amino, carboxyl, carbonyl, oxo, ester, hydroxyl, thio (e.g., thiol), cyano, aryl, heteroaryl, cycloalkyl, cycloalkenyl, cycloalkylalkenyl, cycloalkylalkynyl, cycloalkenylalkyl, cycloalkenylalkenyl, cycloalkenylalkynyl, heterocyclylalkenyl, heterocyclylalkynyl, heteroarylalkenyl, heteroarylalkynyl, arylalkenyl, arylalkynyl, spirocyclyl, heterospirocyclyl, heterocyclyl, thioalkyl (or alkylthio), arylthio, heteroarylthio, sulfone, sulfonyl, sulfoxide, amido, alkylamino, dialkylamino, arylamino, alkylarylamino, diarylamino, N-oxide, imide, enamine, imine, oxime, hydrazone, nitrile, aralkyl, cycloalkylalkyl, haloalkyl, heterocyclylalkyl, heteroarylalkyl, nitro, thioxo, and the like. Suitable reactive groups may include, but are not necessarily limited to, azide, carboxyl, carbonyl, amine (e.g., alkyl amine (e.g., lower alkyl amine), aryl amine), halide, ester (e.g., alkyl ester (e.g., lower alkyl ester, benzyl ester), aryl ester, substituted aryl ester), cyano, thioester, thioether, sulfonyl halide, alcohol, thiol, succinimidyl ester, isothiocyanate, iodoacetamide, maleimide, hydrazine, alkynyl, alkenyl, acetyl, and the like. In some embodiments, the reactive group is selected from a carboxyl, a carbonyl, an amine, an ester, a thioester, a thioether, a sulfonyl halide, an alcohol, a thiol, an alkyne, alkene, an azide, a succinimidyl ester, an isothiocyanate, an iodoacetamide, a maleimide, and a hydrazine. Functional and reactive groups may be unsubstituted or substituted with one or more functional or reactive groups.

"Alkyl" may refer to a straight or branched chain saturated hydrocarbon. For example, $C_1$-$C_6$alkyl groups contain 1 to 6 carbon atoms. Examples of a $C_1$-$C_6$alkyl group include, but are not limited to, methyl, ethyl, propyl, butyl, pentyl, isopropyl, isobutyl, sec-butyl and tert-butyl, isopentyl, and neopentyl.

"Alkenyl" may include an unbranched (i.e., straight) or branched hydrocarbon chain containing 2-12 carbon atoms. The "alkenyl" group contains at least one double bond. The double bond of an alkenyl group can be unconjugated or conjugated to another unsaturated group. Examples of alkenyl groups may include, but are not limited to, ethylenyl, vinyl, allyl, butenyl, pentenyl, hexenyl, butadienyl, pentadienyl, hexadienyl, 2-ethylhexenyl, 2-propyl-2-butenyl, 4-(2-methyl-3-butene)-pentenyl and the like.

Compounds disclosed herein, such as cannabinoids and cannabinoid derivatives, may be substituted with one or more substituents, such as those illustrated generally herein, or as exemplified by particular classes, subclasses, and species of the present disclosure. In general, the term "substituted" refers to the replacement of a hydrogen atom in a given structure with a specified substituent. Combinations of substituents envisioned by the present disclosure are typically those that result in the formation of stable or chemically feasible compounds.

As used herein, the term "unsubstituted" may mean that the specified group bears no substituents beyond the moiety recited (e.g., where valency satisfied by hydrogen).

A reactive group may facilitate covalent attachment of a molecule of interest. Suitable molecules of interest may include, but are not limited to, a detectable label; imaging agents; a toxin (including cytotoxins); a linker; a peptide; a drug (e.g., small molecule drugs); a member of a specific binding pair; an epitope tag; ligands for binding by a target receptor; tags to aid in purification; molecules that increase solubility; and the like. A linker may be a peptide linker or a non-peptide linker.

In some embodiments, a cannabinoid derivative substituted with an azide may be reacted with a compound comprising an alkyne group via "click chemistry" to generate a product comprising a heterocycle, also known as an azide-alkyne cycloaddition. In some embodiments, a cannabinoid derivative substituted with an alkyne may be reacted with a compound comprising an azide group via click chemistry to generate a product comprising a heterocycle.

Additional molecules of interest that may be desirable for attachment to a cannabinoid derivative may include, but are not necessarily limited to, detectable labels (e.g., spin labels, fluorescence resonance energy transfer (FRET)-type dyes, e.g., for studying structure of biomolecules in vivo); small molecule drugs; cytotoxic molecules (e.g., drugs); imaging agents; ligands for binding by a target receptor; tags to aid in purification by, for example, affinity chromatography (e.g., attachment of a FLAG epitope); molecules that increase solubility (e.g., poly(ethylene glycol)); molecules that enhance bioavailability; molecules that increase in vivo half-life; molecules that target to a particular cell type (e.g., an antibody specific for an epitope on a target cell); molecules that target to a particular tissue; molecules that provide for crossing the blood-brain barrier; and molecules to facilitate selective attachment to a surface, and the like.

In some embodiments, a molecule of interest comprises an imaging agent. Suitable imaging agents may include positive contrast agents and negative contrast agents. Suitable positive contrast agents may include, but are not limited to, gadolinium tetraazacyclododecanetetraacetic acid (Gd-DOTA); gadolinium-diethylenetriaminepentaacetic acid (Gd-DTPA); gadolinium-1,4,7-tris(carbonylmethyl)-10-(2'-hydroxypropyl)-1,4,7,10-tetraazacyclododecane (Gd-HP-DO3A); Manganese(II)-dipyridoxal diphosphate (Mn-DPDP); Gd-diethylenetriaminepentaacetate-bis (methylamide) (Gd-DTPA-BMA); and the like. Suitable negative contrast agents may include, but are not limited to, a superparamagnetic iron oxide (SPIO) imaging agent; and a perfluorocarbon, where suitable perfluorocarbons may include, but are not limited to, fluoroheptanes, fluorocycloheptanes, fluoromethylcycloheptanes, fluorohexanes, fluorocyclohexanes, fluoropentanes, fluorocyclopentanes, fluoromethylcyclopentanes, fluorodimethylcyclopentanes, fluoromethylcyclobutanes, fluorodimethylcyclobutanes, fluorotrimethylcyclobutanes, fluorobutanes, fluorocyclobutanse, fluoropropanes, fluoroethers, fluoropolyethers, fluorotriethylamines, perfluorohexanes, perfluoropentanes, perfluorobutanes, perfluoropropanes, sulfur hexafluoride, and the like.

Additional cannabinoid derivatives that can be produced with an engineered variant, method, or modified host cell of the present disclosure may include derivatives that have been modified via organic synthesis or an enzymatic route to modify drug metabolism and pharmacokinetics (e.g., solubility, bioavailability, absorption, distribution, plasma half-life and metabolic clearance). Modification examples may include, but are not limited to, halogenation, acetylation, and methylation.

The cannabinoids or cannabinoid derivatives described herein further include all pharmaceutically acceptable isotopically labeled cannabinoids or cannabinoid derivatives. An "isotopically-" or "radio-labeled" compound is a compound where one or more atoms are replaced or substituted by an atom having an atomic mass or mass number different from the atomic mass or mass number typically found in nature (i.e., naturally occurring). For example, in some embodiments, in the cannabinoids or cannabinoid derivatives described herein, hydrogen atoms are replaced or substituted by one or more deuterium or tritium. Certain isotopically labeled cannabinoids or cannabinoid derivatives of this disclosure, for example, those incorporating a radioactive isotope, are useful in drug and/or substrate tissue distribution studies. The radioactive isotopes tritium, i.e., $^{3}H$, and carbon 14, i.e., $^{14}C$, are particularly useful for this purpose in view of their ease of incorporation and ready means of detection. Substitution with heavier isotopes such as deuterium, i.e., $^{2}H$, may afford certain therapeutic advantages resulting from greater metabolic stability, for example, increased in vivo half-life or reduced dosage requirements, and hence may be preferred in some circumstances. Suitable isotopes that may be incorporated in cannabinoids or cannabinoid derivatives described herein include but are not limited to $^{2}H$ (also written as D for deuterium), $^{3}H$ (also written as T for tritium), $^{11}C$, $^{13}C$, $^{14}C$, $^{13}N$, $^{15}N$, $^{15}O$, $^{17}O$, $^{18}O$, $^{18}F$, $^{35}S$, $^{36}Cl$, $^{82}Br$, $^{75}Br$, $^{76}Br$, $^{77}Br$, $^{123}I$, $^{124}I$, $^{125}I$, and $^{131}I$. Substitution with positron emitting isotopes, such as $^{11}C$, $^{18}F$, $^{15}O$, and $^{13}N$, can be useful in Positron Emission Topography (PET) studies.

The methods of bioproduction, modified host cells, and engineered variants disclosed herein enable synthesis of cannabinoids or cannabinoid derivatives with defined stereochemistries, which is challenging to do using chemical synthesis. Cannabinoids or cannabinoid derivatives disclosed herein may be enantiomers or disastereomers. The term "enantiomers" may refer to a pair of stereoisomers which are non-superimposable mirror images of one another. In some embodiments the cannabinoids or cannabinoid derivatives may be the (S)-enantiomer. In some embodiments the cannabinoids or cannabinoid derivatives may be the (R)-enantiomer. In some embodiments, the cannabinoids or cannabinoid derivatives may be the (+) or (−) enantiomers. The term "diastereomers" may refer to the set of stereoisomers which cannot be made superimposable by rotation around single bonds. For example, cis- and trans-double bonds, endo- and exo-substitution on bicyclic ring systems, and compounds containing multiple stereogenic centers with different relative configurations may be considered to be diastereomers. The term "diastereomer" may refer to any member of this set of compounds. Cannabinoids or cannabinoid derivatives disclosed herein may include a double bond or a fused ring. In certain such embodiments, the double bond or fused ring may be cis or trans, unless the configuration is specifically defined. If the cannabinoid or cannabinoid derivative contains a double bond, the substituent may be in the E or Z configuration, unless the configuration is specifically defined.

In some embodiments when the cannabinoid or cannabinoid derivative is recovered from a cell lysate; from a culture medium; from a modified host cell; from both the cell lysate and the culture medium; from both the modified host cell and the culture medium; from the cell lysate, the modified host cell, and the culture medium; or from a cell-free reaction mixture comprising one or more polypeptides and/or engineered variants disclosed herein, the recovered cannabinoid or cannabinoid derivative is in the form of a salt. In certain such embodiments, the salt is a pharmaceutically acceptable salt. In some embodiments, the salt of the recovered cannabinoid or cannabinoid derivative is then purified as disclosed herein.

The disclosure includes pharmaceutically acceptable salts of the cannabinoids or cannabinoid derivatives described herein. "Pharmaceutically acceptable salts" may refer to those salts which retain the biological effectiveness and properties of the free bases, which are not biologically or otherwise undesirable. Representative pharmaceutically acceptable salts include, but are not limited to, e.g., water-soluble and water-insoluble salts, such as the acetate, amsonate (4,4-diaminostilbene-2,2-disulfonate), benzenesulfonate, benzonate, bicarbonate, bisulfate, bitartrate, borate, bromide, butyrate, calcium, calcium edetate, camsylate, carbonate, chloride, citrate, clavulariate, dihydrochloride, edetate, edisylate, estolate, esylate, fiunarate, gluceptate, gluconate, glutamate, glycollylarsanilate, hexafluorophosphate, hexylresorcinate, hydrabamine, hydrobromide, hydrochloride, hydroxynaphthoate, iodide, sethionate, lactate, lactobionate, laurate, magnesium, malate, maleate, mandelate, mesylate, methylbromide, methylnitrate, methylsulfate, mucate, napsylate, nitrate, N-methylglucamine ammonium salt, 3-hydroxy-2-naphthoate, oleate, oxalate, palmitate, pamoate (1,1-methene-bis-2-hydroxy-3-naphthoate, einbonate), pantothenate, phosphate/diphosphate, picrate, polygalacturonate, propionate, p-toluenesulfonate, salicylate, stearate, subacetate, succinate, sulfate, sulfosalicylate, suramate, tannate, tartrate, teoclate, tosylate, triethiodide, and valerate salts.

"Pharmaceutically acceptable salt" also includes both acid and base addition salts. "Pharmaceutically acceptable acid addition salt" may refer to those salts which retain the biological effectiveness and properties of the free bases, which are not biologically or otherwise undesirable, and which are formed with inorganic acids such as, but are not limited to, hydrochloric acid, hydrobromic acid, sulfuric acid, nitric acid, phosphoric acid and the like, and organic acids such as, but not limited to, acetic acid, 2,2-dichloroacetic acid, adipic acid, alginic acid, ascorbic acid, aspartic acid, benzenesulfonic acid, benzoic acid, 4-acetamidobenzoic acid, camphoric acid, camphor-10-sulfonic acid, capric acid, caproic acid, caprylic acid, carbonic acid, cinnamic acid, citric acid, cyclamic acid, dodecylsulfuric acid, ethane-1,2-disulfonic acid, ethanesulfonic acid, 2-hydroxyethanesulfonic acid, formic acid, fumaric acid, galactaric acid, gentisic acid, glucoheptonic acid, gluconic acid, glucuronic acid, glutamic acid, glutaric acid, 2-oxo-glutaric acid, glycerophosphoric acid, glycolic acid, hippuric acid, isobutyric acid, lactic acid, lactobionic acid, lauric acid, maleic acid, malic acid, malonic acid, mandelic acid, methanesulfonic acid, mucic acid, naphthalene-1,5-disulfonic acid, naphthalene-2-sulfonic acid, 1-hydroxy-2-naphthoic acid, nicotinic acid, oleic acid, orotic acid, oxalic acid, palmitic acid, pamoic acid, propionic acid, pyroglutamic acid, pyruvic acid, salicylic acid, 4-aminosalicylic acid, sebacic acid, stearic acid, succinic acid, tartaric acid, thiocyanic acid, p-toluenesulfonic acid, trifluoroacetic acid, undecylenic acid, and the like.

"Pharmaceutically acceptable base addition salt" may refer to those salts which retain the biological effectiveness and properties of the free acids, which are not biologically or otherwise undesirable. These salts are prepared from addition of an inorganic base or an organic base to the free acid. Salts derived from inorganic bases include, but are not limited to, the sodium, potassium, lithium, ammonium, calcium, magnesium, iron, zinc, copper, manganese, aluminum salts and the like. For example, inorganic salts include, but are not limited to, ammonium, sodium, potassium, calcium, and magnesium salts. Salts derived from organic bases include, but are not limited to, salts of primary, secondary, and tertiary amines, substituted amines including naturally occurring substituted amines, cyclic amines and basic ion exchange resins, such as ammonia, isopropylamine, trimethylamine, diethylamine, triethylamine, tripropylamine, diethanolamine, ethanolamine, deanol, 2-dimethylaminoethanol, 2-diethylaminoethanol, dicyclohexylamine, lysine, arginine, histidine, caffeine, procaine, hydrabamine, choline, betaine, benethamine, benzathine, ethylenediamine, glucosamine, methylglucamine, theobromine, triethanolamine, tromethamine, purines, piperazine, piperidine, N-ethylpiperidine, polyamine resins and the like.

The disclosure provides a method of producing a cannabinoid or a cannabinoid derivative, the method comprising use of an engineered variant of the disclosure. In certain such embodiments, the cannabinoid or the cannabinoid derivative is produced in an amount, as measured in mg/L or mM, greater than an amount of the cannabinoid or the cannabinoid derivative produced in a method comprising use of a cannabidiolic acid synthase polypeptide having an amino acid sequence of SEQ ID NO:3 instead of the engineered variant of the disclosure. In certain such embodiments, the engineered variant of the disclosure and the cannabidiolic acid synthase polypeptide having the amino acid sequence of SEQ ID NO:3 are used under similar conditions for the same length of time. In some embodiments of the methods of producing a cannabinoid or a cannabinoid derivative of the disclosure, the cannabinoid or the cannabinoid derivative is produced in an amount, as measured in mg/L or mM, at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% greater than an amount of the cannabinoid or the cannabinoid derivative produced in a method comprising use of a cannabidiolic acid synthase polypeptide having an amino acid sequence of SEQ ID NO:3 instead of the engineered variant of the disclosure. In certain such embodiments, the engineered variant of the disclosure and the cannabidiolic acid synthase polypeptide having the amino acid sequence of SEQ ID NO:3 are used under similar conditions for the same length of time.

In some embodiments of the methods of producing a cannabinoid or a cannabinoid derivative of the disclosure, the cannabinoid is CBDA and the method produces CBDA in an increased ratio of CBDA over THCA compared to that produced in a method comprising use of a cannabidiolic acid synthase polypeptide having an amino acid sequence of SEQ ID NO:3 instead of the engineered variant of the disclosure. In certain such embodiments, the engineered variant of the disclosure and the cannabidiolic acid synthase polypeptide having the amino acid sequence of SEQ ID NO:3 are used under similar conditions for the same length of time. In some embodiments of the methods of producing a cannabinoid or a cannabinoid derivative of the disclosure, the cannabinoid is CBDA and the method produces CBDA from CBGA in a ratio of CBDA over THCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

In some embodiments of the methods of producing a cannabinoid or a cannabinoid derivative of the disclosure, the cannabinoid is CBDA and the method produces CBDA in an increased ratio of CBDA over CBCA compared to that produced in a method comprising use of a cannabidiolic acid synthase polypeptide having an amino acid sequence of SEQ ID NO:3 instead of the engineered variant of the disclosure.

In certain such embodiments, the engineered variant of the disclosure and the cannabidiolic acid synthase polypeptide having the amino acid sequence of SEQ ID NO:3 are used under similar conditions for the same length of time. In some embodiments of the methods of producing a cannabinoid or a cannabinoid derivative of the disclosure, the cannabinoid is CBDA and the method produces CBDA from CBGA in a ratio of CBDA over CBCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

Methods of Using Host Cells to Generate Cannabinoids or Cannabinoid Derivatives

The disclosure provides methods of producing a cannabinoid or a cannabinoid derivative, such as those described herein, the method comprising: culturing a modified host cell of the disclosure in a culture medium. In certain such embodiments, the method comprises recovering the produced cannabinoid or cannabinoid derivative. In certain such embodiments, the produced cannabinoid or cannabinoid derivative is then purified as disclosed herein.

In some embodiments, culturing of the modified host cells of the disclosure in a culture medium provides for synthesis of a cannabinoid or a cannabinoid derivative, such as those described herein, in an increased amount compared to an unmodified host cell cultured under similar conditions.

The disclosure provides methods of producing a cannabinoid or a cannabinoid derivative, such as those described herein, the method comprising: culturing a modified host cell of the disclosure in a culture medium comprising a carboxylic acid. In certain such embodiments, the method comprises recovering the produced cannabinoid or cannabinoid derivative. In certain such embodiments, the produced cannabinoid or cannabinoid derivative is then purified as disclosed herein.

In some embodiments, the cannabinoid or cannabinoid derivative is recovered from a cell lysate; from a culture medium; from a modified host cell; from both the cell lysate and the culture medium; from both the modified host cell and the culture medium; or from the cell lysate, the modified host cell, and the culture medium. In certain such embodiments, the recovered cannabinoid or cannabinoid derivative is then purified as disclosed herein. In some embodiments when the cannabinoid or cannabinoid derivative is recovered from the cell lysate; from the culture medium; from the modified host cell; from both the cell lysate and the culture medium; from both the modified host cell and the culture medium; or from the cell lysate, the modified host cell, and the culture medium, the recovered cannabinoid or cannabinoid derivative is in the form of a salt. In certain such embodiments, the salt is a pharmaceutically acceptable salt. In some embodiments, the salt of the recovered cannabinoid or cannabinoid derivative is then purified as disclosed herein.

In some embodiments, the modified host cell of the present disclosure is cultured in a culture medium comprising a carboxylic acid. In some embodiments, the carboxylic acid may be substituted with or comprise one or more functional and/or reactive groups. Functional groups may include, but are not limited to, azido, halo (e.g., chloride, bromide, iodide, fluorine), methyl, alkyl, alkynyl, alkenyl, methoxy, alkoxy, acetyl, amino, carboxyl, carbonyl, oxo, ester, hydroxyl, thio (e.g., thiol), cyano, aryl, heteroaryl, cycloalkyl, cycloalkenyl, cycloalkylalkenyl, cycloalkylalkynyl, cycloalkenylalkyl, cycloalkenylalkenyl, cycloalkenylalkynyl, heterocyclylalkenyl, heterocyclylalkynyl, heteroarylalkenyl, heteroarylalkynyl, arylalkenyl, arylalkynyl, spirocyclyl, heterospirocyclyl, heterocyclyl, thioalkyl (or alkylthio), arylthio, heteroarylthio, sulfone, sulfonyl, sulfoxide, amido, alkylamino, dialkylamino, arylamino, alkylarylamino, diarylamino, N-oxide, imide, enamine, imine, oxime, hydrazone, nitrile, aralkyl, cycloalkylalkyl, haloalkyl, heterocyclylalkyl, heteroarylalkyl, nitro, thioxo, and the like. Reactive groups may include, but are not necessarily limited to, azide, halogen, carboxyl, carbonyl, amine (e.g., alkyl amine (e.g., lower alkyl amine), aryl amine), ester (e.g., alkyl ester (e.g., lower alkyl ester, benzyl ester), aryl ester, substituted aryl ester), cyano, thioester, thioether, sulfonyl halide, alcohol, thiol, succinimidyl ester, isothiocyanate, iodoacetamide, maleimide, hydrazine, alkynyl, alkenyl, and the like. In some embodiments, the reactive group is selected from a carboxyl, a carbonyl, an amine, an ester, thioester, thioether, a sulfonyl halide, an alcohol, a thiol, a succinimidyl ester, an isothiocyanate, an iodoacetamide, a maleimide, an azide, an alkyne, an alkene, and a hydrazine. Functional and reactive groups may be unsubstituted or substituted with one or more functional or reactive groups.

In some embodiments, the carboxylic acid is isotopically- or radio-labeled. In some embodiments, the carboxylic acid may be an enantiomer or diastereomer. In some embodiments the carboxylic acid may be the (S)-enantiomer. In some embodiments the carboxylic acid may be the (R)-enantiomer. In some embodiments, the carboxylic acid may be the (+) or (−) enantiomer. In some embodiments, the carboxylic acid may include a double bond or a fused ring. In certain such embodiments, the double bond or fused ring may be cis or trans, unless the configuration is specifically defined. If the carboxylic acid contains a double bond, the substituent may be in the E or Z configuration, unless the configuration is specifically defined.

In some embodiments, the carboxylic acid comprises a C═C group. In some embodiments, the carboxylic acid comprises an alkyne group. In some embodiments, the carboxylic acid comprises an $N_3$ group. In some embodiments, the carboxylic acid comprises a halogen. In some embodiments, the carboxylic acid comprises a CN group. In some embodiments, the carboxylic acid comprises iodo. In some embodiments, the carboxylic acid comprises bromo. In some embodiments, the carboxylic acid comprises chloro. In some embodiments, the carboxylic acid comprises fluoro. In some embodiments, the carboxylic acid comprises a carbonyl. In some embodiments, the carboxylic acid comprises an acetyl. In some embodiments, the carboxylic acid comprises an alkyl group. In some embodiments, the carboxylic acid comprises an aryl group.

Carboxylic acids may include, but are not limited to, unsubstituted or substituted $C_3$-$C_{18}$ fatty acids, $C_3$-$C_{18}$ carboxylic acids, $C_1$-$C_{18}$ carboxylic acids, butyric acid, isobutyric acid, valeric acid, hexanoic acid, heptanoic acid, octanoic acid, nonanoic acid, decanoic acid, undecanoic acid, lauric acid, myristic acid, $C_{15}$-$C_{18}$ fatty acids, $C_{15}$-$C_{18}$ carboxylic acids, fumaric acid, itaconic acid, malic acid, succinic acid, maleic acid, malonic acid, glutaric acid, glucaric acid, oxalic acid, adipic acid, pimelic acid, suberic acid, azelaic acid, sebacic acid, dodecanedioic acid, glutaconic acid, ortho-phthalic acid, isophthalic acid, terephthalic acid, citric acid, isocitric acid, aconitic acid, tricarballylic acid, and trimesic acid. Carboxylic acids may include unsubstituted or substituted $C_1$-$C_{18}$ carboxylic acids.

Carboxylic acids may include unsubstituted or substituted $C_3$-$C_{18}$ carboxylic acids. Carboxylic acids may include unsubstituted or substituted $C_3$-$C_{12}$ carboxylic acids. Carboxylic acids may include unsubstituted or substituted $C_4$-$C_{10}$ carboxylic acids. In some embodiments, the carboxylic acid is an unsubstituted or substituted $C_4$ carboxylic acid. In some embodiments, the carboxylic acid is an unsubstituted or substituted $C_5$ carboxylic acid. In some embodiments, the carboxylic acid is an unsubstituted or substituted $C_6$ carboxylic acid. In some embodiments, the carboxylic acid is an unsubstituted or substituted $C_7$ carboxylic acid. In some embodiments, the carboxylic acid is an unsubstituted or substituted $C_8$ carboxylic acid. In some embodiments, the carboxylic acid is an unsubstituted or substituted $C_9$ carboxylic acid. In some embodiments, the carboxylic acid is an unsubstituted or substituted $C_{10}$ carboxylic acid. In some embodiments, the carboxylic acid is unsubstituted or substituted butyric acid. In some embodiments, carboxylic acid is unsubstituted or substituted valeric acid. In some embodiments, the carboxylic acid is unsubstituted or substituted hexanoic acid. In some embodiments, the carboxylic acid is unsubstituted or substituted heptanoic acid. In some embodiments, the carboxylic acid is unsubstituted or substituted octanoic acid. In some embodiments, the carboxylic acid is unsubstituted or substituted nonanoic acid. In some embodiments, the carboxylic acid is unsubstituted or substituted decanoic acid.

Carboxylic acids may include, but are not limited to, 2-methylhexanoic acid, 3-methylhexanoic acid, 4-methylhexanoic acid, 5-methylhexanoic acid, 2-hexenoic acid, 3-hexenoic acid, 4-hexenoic acid, 5-hexenoic acid, 5-chlorovaleric acid, 5-aminovaleric acid, 5-cyanovaleric acid, 5-(methylsulfanyl)valeric acid, 5-hydroxyvaleric acid, 5-phenylvaleric acid, 2,3-dimethylhexanoic acid, d3-hexanoic acid, 4-pentynoic acid, trans-2-pentenoic acid, 5-hexynoic acid, trans-2-hexenoic acid, 6-heptynoic acid, trans-2-octenoic acid, trans-2-nonenoic acid, 4-phenylbutyric acid, 6-phenylhexanoic acid, 7-phenylyheptanoic acid, and the like. In some embodiments, the carboxylic acid is 2-methylhexanoic acid. In some embodiments, the carboxylic acid is 3-methylhexanoic acid. In some embodiments, the carboxylic acid is 4-methylhexanoic acid. In some embodiments, the carboxylic acid is 5-methylhexanoic acid. In some embodiments, the carboxylic acid is 2-hexenoic acid. In some embodiments, the carboxylic acid is 3-hexenoic acid. In some embodiments, the carboxylic acid is 4-hexenoic acid. In some embodiments, the carboxylic acid is 5-hexenoic acid. In some embodiments, the carboxylic acid is 5-chlorovaleric acid. In some embodiments, the carboxylic acid is 5-aminovaleric acid. In some embodiments, the carboxylic acid is 5-cyanovaleric acid. In some embodiments, the carboxylic acid is 5-(methylsulfanyl)valeric acid. In some embodiments, the carboxylic acid is 5-hydroxyvaleric acid. In some embodiments, the carboxylic acid is 5-phenylvaleric acid. In some embodiments, the carboxylic acid is 2,3-dimethylhexanoic acid. In some embodiments, the carboxylic acid is d3-hexanoic acid. In some embodiments, the carboxylic acid is 4-pentynoic acid. In some embodiments, the carboxylic acid is trans-2-pentenoic acid. In some embodiments, the carboxylic acid is 5-hexynoic acid. In some embodiments, the carboxylic acid is trans-2-hexenoic acid. In some embodiments, the carboxylic acid is 6-heptynoic acid. In some embodiments, the carboxylic acid is trans-2-octenoic acid. In some embodiments, the carboxylic acid is trans-2-nonenoic acid. In some embodiments, the carboxylic acid is 4-phenylbutyric acid. In some embodiments, the carboxylic acid is 6-phenylhexanoic acid. In some embodiments, the carboxylic acid is 7-phenylheptanoic acid.

In some embodiments wherein the modified host cell of the present disclosure is cultured in a culture medium comprising a carboxylic acid, the carboxylic acid is an unsubstituted or substituted $C_3$-$C_{18}$ carboxylic acid. In certain such embodiments, the unsubstituted or substituted $C_3$-$C_{18}$ carboxylic acid is an unsubstituted or substituted hexanoic acid. In some embodiments, the cannabinoid or cannabinoid derivative is produced in an amount of more than 100 mg/L culture medium. In some embodiments, the cannabinoid or cannabinoid derivative is produced in an amount of more than 50 mg/L culture medium.

In some embodiments wherein the modified host cell of the present disclosure is cultured in a culture medium comprising a carboxylic acid, the carboxylic acid is butyric acid, valeric acid, hexanoic acid, octanoic acid, 2-methylhexanoic acid, 3-methylhexanoic acid, 4-methylhexanoic acid, 5-methylhexanoic acid, 2-hexenoic acid, 3-hexenoic acid, 4-hexenoic acid, 5-hexenoic acid, heptanoic acid, 5-chlorovaleric acid, 5-(methylsulfanyl)valeric acid, 4-pentynoic acid, trans-2-pentenoic acid, 5-hexynoic acid, trans-2-hexenoic acid, 6-heptynoic acid, trans-2-octenoic acid, nonanoic acid, trans-2-nonenoic acid, decanoic acid, undecanoic acid, dodecanoic acid, myristic acid, 4-phenylbutyric acid, 5-phenylvaleric acid, 6-phenylhexanoic acid, 7-phenylheptanoic acid, isobutyric acid, fumaric acid, itaconic acid, malic acid, succinic acid, maleic acid, malonic acid, glutaric acid, glucaric acid, oxalic acid, adipic acid, pimelic acid, suberic acid, azelaic acid, sebacic acid, dodecandioic acid, glutaconic acid, ortho-phthalic acid, isophthalic acid, terephthalic acid, citric acid, isocitric acid, aconitic acid, tricarballylic acid, trimesic acid, 5-aminovaleric acid, 5-cyanovaleric acid, 5-hydroxyvaleric acid, or 2,3-dimethylhexanoic acid. In some embodiments, the cannabinoid or cannabinoid derivative is produced in an amount of more than 100 mg/L culture medium. In some embodiments, the cannabinoid or cannabinoid derivative is produced in an amount of more than 50 mg/L culture medium.

In some embodiments wherein the modified host cell of the present disclosure is cultured in a culture medium comprising a carboxylic acid, the carboxylic acid is butyric acid, valeric acid, hexanoic acid, octanoic acid, 2-methylhexanoic acid, 3-methylhexanoic acid, 4-methylhexanoic acid, 5-methylhexanoic acid, 2-hexenoic acid, 3-hexenoic acid, 4-hexenoic acid, 5-hexenoic acid, heptanoic acid, 5-chlorovaleric acid, 5-(methylsulfanyl)valeric acid, 4-pentynoic acid, trans-2-pentenoic acid, 5-hexynoic acid, trans-2-hexenoic acid, 6-heptynoic acid, trans-2-octenoic acid, nonanoic acid, trans-2-nonenoic acid, decanoic acid, undecanoic acid, dodecanoic acid, myristic acid, 4-phenylbutyric acid, 5-phenylvaleric acid, 6-phenylhexanoic acid, 7-phenylheptanoic acid, isobutyric acid, fumaric acid, succinic acid, maleic acid, malonic acid, glutaric acid, oxalic acid, adipic acid, pimelic acid, suberic acid, azelaic acid, sebacic acid, dodecandioic acid, ortho-phthalic acid, isophthalic acid, terephthalic acid, trimesic acid, 5-aminovaleric acid, 5-cyanovaleric acid, 5-hydroxyvaleric acid, or 2,3-dimethylhexanoic acid. In some embodiments, the cannabinoid or cannabinoid derivative is produced in an amount of more than 100 mg/L culture medium. In some embodiments, the cannabinoid or cannabinoid derivative is produced in an amount of more than 50 mg/L culture medium.

In some embodiments wherein the modified host cell of the present disclosure is cultured in a culture medium comprising a carboxylic acid, the carboxylic acid is 2-methylhexanoic acid, 3-methylhexanoic acid, 4-methylhexanoic acid, 5-methylhexanoic acid, 2-hexenoic acid, 3-hexenoic acid, 4-hexenoic acid, heptanoic acid, 5-chlorovaleric acid, 5-(methylsulfanyl)valeric acid, 4-pentynoic acid, trans-2-pentenoic acid, 5-hexynoic acid, trans-2-hexenoic acid, 6-heptynoic acid, trans-2-octenoic acid, nonanoic acid, trans-2-nonenoic acid, decanoic acid, undecanoic acid, dodecanoic acid, myristic acid, 4-phenylbutyric acid, 5-phenylvaleric acid, 6-phenylhexanoic acid, 7-phenylheptanoic acid, isobutyric acid, fumaric acid, itaconic acid, malic acid, maleic acid, glucaric acid, suberic acid, azelaic acid, sebacic acid, dodecandioic acid, glutaconic acid, ortho-phthalic acid, isophthalic acid, terephthalic acid, citric acid, isocitric acid, aconitic acid, tricarballylic acid, trimesic acid, 5-aminovaleric acid, 5-cyanovaleric acid, 5-hydroxyvaleric acid, or 2,3-dimethylhexanoic acid. In some embodiments, the cannabinoid or cannabinoid derivative is produced in an amount of more than 100 mg/L culture medium. In some embodiments, the cannabinoid or cannabinoid derivative is produced in an amount of more than 50 mg/L culture medium.

In some embodiments wherein the modified host cell of the present disclosure is cultured in a culture medium comprising a carboxylic acid, the carboxylic acid is 2-methylhexanoic acid, 3-methylhexanoic acid, 4-methylhexanoic acid, 5-methylhexanoic acid, 2-hexenoic acid, 3-hexenoic acid, 4-hexenoic acid, heptanoic acid, 5-chlorovaleric acid, 5-(methylsulfanyl)valeric acid, 4-pentynoic acid, trans-2-pentenoic acid, 5-hexynoic acid, trans-2-hexenoic acid, 6-heptynoic acid, trans-2-octenoic acid, nonanoic acid, trans-2-nonenoic acid, decanoic acid, undecanoic acid, dodecanoic acid, myristic acid, 4-phenylbutyric acid, 5-phenylvaleric acid, 6-phenylhexanoic acid, 7-phenylheptanoic acid, isobutyric acid, fumaric acid, maleic acid, suberic acid, azelaic acid, sebacic acid, dodecandioic acid, ortho-phthalic acid, isophthalic acid, terephthalic acid, trimesic acid, 5-aminovaleric acid, 5-cyanovaleric acid, 5-hydroxyvaleric acid, or 2,3-dimethylhexanoic acid. In some embodiments, the cannabinoid or cannabinoid derivative is produced in an amount of more than 100 mg/L culture medium. In some embodiments, the cannabinoid or cannabinoid derivative is produced in an amount of more than 50 mg/L culture medium.

In some embodiments wherein the modified host cell of the present disclosure is cultured in a culture medium comprising a carboxylic acid, the carboxylic acid is 4-pentynoic acid, trans-2-pentenoic acid, 5-hexynoic acid, trans-2-hexenoic acid, 6-heptynoic acid, trans-2-octenoic acid, nonanoic acid, trans-2-nonenoic acid, decanoic acid, undecanoic acid, dodecanoic acid, 4-phenylbutyric acid, 5-phenylvaleric acid, 6-phenylhexanoic acid, or 7-phenylheptanoic acid. In some embodiments, the cannabinoid or cannabinoid derivative is produced in an amount of more than 100 mg/L culture medium. In some embodiments, the cannabinoid or cannabinoid derivative is produced in an amount of more than 50 mg/L culture medium.

In some embodiments wherein the modified host cell of the present disclosure is cultured in a culture medium comprising a carboxylic acid, the carboxylic acid is 2-methylhexanoic acid, 4-methylhexanoic acid, 5-methylhexanoic acid, 2-hexenoic acid, 3-hexenoic acid, 4-hexenoic acid, heptanoic acid, 5-chlorovaleric acid, or 5-(methylsulfanyl) valeric acid. In some embodiments, the cannabinoid or cannabinoid derivative is produced in an amount of more than 100 mg/L culture medium. In some embodiments, the cannabinoid or cannabinoid derivative is produced in an amount of more than 50 mg/L culture medium.

The disclosure also provides methods of producing a cannabinoid or a cannabinoid derivative, such as those described herein, the method comprising: culturing a modified host cell of the disclosure in a culture medium comprising olivetolic acid or an olivetolic acid derivative. In certain such embodiments, the method comprises recovering the produced cannabinoid or cannabinoid derivative. In certain such embodiments, the produced cannabinoid or cannabinoid derivative is then purified as disclosed herein.

Olivetolic acid derivatives used herein may be substituted with or comprise one or more reactive and/or functional groups as disclosed herein. In some embodiments, an olivetolic acid derivative may lack one or more chemical moieties found in olivetolic acid. In some embodiments when the culture medium comprises an olivetolic acid derivative, the olivetolic acid derivative is orsellinic acid. In some embodiments when the culture medium comprises an olivetolic acid derivative, the olivetolic acid derivative is divarinic acid. In some embodiments, the cannabinoid or cannabinoid derivative is produced in an amount of more than 100 mg/L culture medium. In some embodiments, the cannabinoid or cannabinoid derivative is produced in an amount of more than 50 mg/L culture medium.

The disclosure provides methods of using a modified host cell of the disclosure for producing a cannabinoid or cannabinoid derivative. In some embodiments of the methods of using a modified host cell of the disclosure for producing a cannabinoid or cannabinoid derivative, the cannabinoid or the cannabinoid derivative is produced in an amount, as measured in mg/L or mM, greater than an amount of the cannabinoid or the cannabinoid derivative produced in a method instead comprising culturing a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant. In certain such embodiments, the modified host cell of the disclosure and the modified host cell comprising one or more nucleic acids comprising the nucleotide sequence encoding the cannabidiolic acid synthase polypeptide having the amino acid sequence of SEQ ID NO:3, but lacking a nucleic acid comprising a nucleotide sequence encoding an engineered variant, are cultured under similar culture conditions for the same length of time.

In some embodiments of the methods of using a modified host cell of the disclosure for producing a cannabinoid or cannabinoid derivative, the cannabinoid or the cannabinoid derivative is produced in an amount, as measured in mg/L or mM, at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% greater than an amount of the cannabinoid or the cannabinoid derivative produced in a method instead comprising culturing a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant. In certain such embodiments, the modified host cell of the disclosure and the modified host cell comprising one or more nucleic acids comprising the nucleotide sequence encoding the cannabidiolic acid synthase polypeptide having the amino acid sequence of SEQ ID NO:3, but lacking a nucleic acid comprising a nucleotide sequence encoding an engineered variant, are cultured under similar culture conditions for the same length of time.

In some embodiments of the methods of using a modified host cell of the disclosure for producing a cannabinoid or cannabinoid derivative, the cannabinoid is CBDA and the method produces CBDA in an increased ratio of CBDA over THCA compared to that produced in a method instead comprising culturing a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. In some embodiments of the methods of using a modified host cell of the disclosure for producing a cannabinoid or cannabinoid derivative, the cannabinoid is CBDA and the method produces CBDA from CBGA in a ratio of CBDA over THCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

In some embodiments of the methods of using a modified host cell of the disclosure for producing a cannabinoid or cannabinoid derivative, the cannabinoid is CBDA and the method produces CBDA in an increased ratio of CBDA over CBCA compared to that produced in a method instead comprising culturing a modified host cell comprising one or more nucleic acids comprising a nucleotide sequence encoding a cannabidiolic acid synthase polypeptide having an amino acid sequence of SEQ ID NO:3, but lacking a nucleic acid comprising a nucleotide sequence encoding an engineered variant, grown under similar culture conditions for the same length of time. In some embodiments of the methods of using a modified host cell of the disclosure for producing a cannabinoid or cannabinoid derivative, the cannabinoid is CBDA and the method produces CBDA from CBGA in a ratio of CBDA over CBCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

Exemplary Cell Culture Conditions

Suitable media for culturing modified host cells of the disclosure may include standard culture media (e.g., Luria-Bertani broth, optionally supplemented with one or more additional agents, such as an inducer (e.g., where nucleic acids disclosed herein are under the control of an inducible promoter, etc.); standard yeast culture media; and the like). In some embodiments, the culture medium can be supplemented with a fermentable sugar (e.g., a hexose sugar or a pentose sugar, e.g., glucose, xylose, galactose, and the like). Sugars fermentable by yeast may include, but are not limited to, sucrose, dextrose, glucose, fructose, mannose, galactose, and maltose.

In some embodiments, the culture medium can be supplemented with unsubstituted or substituted hexanoic acid, carboxylic acids other than unsubstituted or substituted hexanoic acid, olivetolic acid, or olivetolic acid derivatives. In some embodiments, the culture medium can be supplemented with pretreated cellulosic feedstock (e.g., wheat grass, wheat straw, barley straw, sorghum, rice grass, sugarcane straw, bagasse, switchgrass, corn stover, corn fiber, grains, or any combination thereof). In some embodiments, the culture medium can be supplemented with oleic acid. In some embodiments, the culture medium comprises a non-fermentable carbon source. In certain such embodiments, the non-fermentable carbon source comprises ethanol. In some embodiments, the suitable media comprises an inducer. In certain such embodiments, the inducer comprises galactose. In some embodiments, the inducer comprises $KH_2PO_4$, galactose, glucose, sucrose, maltose, an amino acid (e.g., methionine, lysine), $CuSO_4$, a change in temperature (e.g., 30° C. to 37° C.), a change in pH (e.g., pH 6 to pH 4), a change in oxygen level (e.g., 20% to 1% dissolved oxygen levels), addition of hydrogen peroxide or superoxide-generating drug menadione, tunicamycin, expression of proteins prone to misfolding (e.g., cannabinoid synthases), estradiol, or doxycycline. Additional induction systems are detailed herein.

The carbon source in the suitable media can vary significantly, from simple sugars like glucose to more complex hydrolysates of other biomass, such as yeast extract. The addition of salts generally provide essential elements such as magnesium, nitrogen, phosphorus, and sulfur to allow the cells to synthesize polypeptides and nucleic acids. The suitable media can also be supplemented with selective agents, such as antibiotics, to select for the maintenance of certain plasmids and the like. For example, if a microorganism is resistant to a certain antibiotic, such as ampicillin or tetracycline, then that antibiotic can be added to the medium in order to prevent cells lacking the resistance from growing. The suitable media can be supplemented with other compounds as necessary to select for desired physiological or biochemical characteristics, such as particular amino acids and the like.

In some embodiments, modified host cells disclosed herein are grown in minimal medium or minimal media. As used herein, the terms "minimal medium" or "minimal media" may refer to media comprising a defined composition of nutrients, generally chosen for minimal cost, while still allowing for robust growth and production. As used herein, the terms "minimal medium" or "minimal media" may refer to media containing: (1) one or more carbon sources for cellular (e.g., bacterial or yeast) growth; (2) various salts, which can vary among cellular (e.g., bacterial or yeast) species and growing conditions; (3) vitamins and trace elements; and (4) water. Generally, but not always, minimal media lacks one or more amino acids (e.g., 1, 2, 3, 4, 5, 6, 7, 8, 9, 10, or more amino acids). Minimal media may also comprise growth factors, inducers, and repressors. In some embodiments, minimal media or minimal medium affords higher biomass formation in a fermentation tank compared to rich medium or rich media. In some embodiments, the minimal medium or minimal media comprises a carboxylic acid (e.g., 1 mM olivetolic acid, 1 mM olivetolic acid derivative, 2 mM unsubstituted or substituted hexanoic acid, or 2 mM of a carboxylic acid other than unsubstituted or substituted hexanoic acid).

In some embodiments, modified host cells disclosed herein are grown in rich medium or rich media. In certain such embodiments, the rich medium or rich media comprises yeast extract peptone dextrose (YPD) media comprising water, yeast extract, Bacto peptone, and dextrose (glucose). In certain such embodiments, the rich medium or rich media comprises yeast extract peptone dextrose (YPD) media comprising water, 10 g/L yeast extract, 20 g/L Bacto peptone, and 20 g/L dextrose (glucose). In some embodiments, the rich medium or rich media comprises YP+galactose and glucose. In some embodiments, the rich medium or rich media comprises YP+20 g/L galactose or YP+40 g/L galactose and 1 g/L glucose. In some embodiments, the rich medium or rich media comprises a carboxylic acid (e.g., 1 mM olivetolic acid, 1 mM olivetolic acid derivative, 2 mM unsubstituted or substituted hexanoic acid, or 2 mM of a carboxylic acid other than unsubstituted or substituted hexanoic acid). In some embodiments, rich medium or rich media affords greater cell density in fermentation compared to minimal media or minimal medium.

Materials and methods suitable for the maintenance and growth of the recombinant cells of the disclosure are described herein, e.g., in the Examples section. Other materials and methods suitable for the maintenance and growth of cell (e.g., bacterial or yeast) cultures are well known in the art. Exemplary techniques can be found in International Publication No. WO2009/076676, U.S. patent application Ser. No. 12/335,071 (U.S. Publ. No. 2009/0203102), WO 2010/003007, US Publ. No. 2010/0048964, WO 2009/132220, US Publ. No. 2010/0003716, Manual of Methods for General Bacteriology Gerhardt et al, eds), American Society for Microbiology, Washington, D.C. (1994) or Brock in Biotechnology: A Textbook of Industrial Microbiology, Second Edition (1989) Sinauer Associates, Inc., Sunderland, MA.

Standard cell culture conditions can be used to culture the modified host cells disclosed herein (see, for example, WO 2004/033646 and references cited therein). In some embodiments, cells are grown and maintained at an appropriate temperature, gas mixture, and pH (such as at about 20° C. to about 37° C., at about 0.04% to about 84% $CO_2$, at about 0% to about 100% dissolved oxygen, and at a pH between about 2 to about 9). In some embodiments, modified host cells disclosed herein are grown at about 34° C. in a suitable cell culture medium. In some embodiments, modified host cells disclosed herein are grown at about 20° C. to about 37° C. in a suitable cell culture medium. While the growth optimum for *S. cerevisiae* is about 30° C., culturing cells at a higher temperature, e.g., 34° C. may be advantageous by reducing the costs to cool industrial fermentation tanks. In some embodiments, modified host cells disclosed herein are grown at about 20° C., about 21° C., about 22° C., about 23° C., about 24° C., about 25° C., about 26° C., about 27° C., about 28° C., about 29° C., about 30° C., about 31° C., about 32° C., about 33° C., about 34° C., about 35° C., about 36° C., or about 37° C. in a suitable cell culture medium. In some embodiments, the pH ranges for fermentation are between about pH 3.0 to about pH 9.0 (such as about pH 3.0, about pH 3.5, about pH 4.0, about pH 4.5, about pH 5.0, about pH 5.5, about pH 6.0, about pH 6.5, about pH 7.0, about pH 7.5, about pH 8.0, about pH 8.5, about pH 6.0 to about pH 8.0 or about pH 6.5 to about pH 7.0). In some embodiments, the pH ranges for fermentation are between about pH 4.5 to about pH 5.5. In some embodiments, the pH ranges for fermentation are between about pH 4.0 to about pH 6.0. In some embodiments, the pH ranges for fermentation are between about pH 3.0 to about pH 6.0. In some embodiments, the pH ranges for fermentation are between about pH 3.0 to about pH 5.5. In some embodiments, the pH ranges for fermentation are between about pH 3.0 to about pH 5.0. In some embodiments, the dissolved oxygen is between about 0% to about 10%, about 0% to about 20%, about 0% to about 30%, about 0% to about 40%, about 0% to about 50%, about 0% to about 60%, about 0% to about 70%, about 0% to about 80%, about 0% to about 90%, about 5% to about 10%, about 5% to about 20%, about 5% to about 30%, about 5% to about 40%, about 5% to about 50%, about 5% to about 60%, about 5% to about 70%, about 5% to about 80%, about 5% to about 90%, about 10% to about 20%, about 10% to about 30%, about 10% to about 40% or about 10% to about 50%. In some embodiments, the $CO_2$ level is between about 0.04% to about 0.1% $CO_2$, about 0.04% to about 1% $CO_2$, about 0.04% to about 5% $CO_2$, about 0.04% to about 10% $CO_2$, about 0.04% to about 20% $CO_2$, about 0.04% to about 30% $CO_2$, about 0.04% to about 40% $CO_2$, about 0.04% to about 50% $CO_2$, about 0.04% to about 60% $CO_2$, about 0.04% to about 70% $CO_2$, about 0.1% to about 5% $CO_2$, about 0.1% to about 10% $CO_2$, about 0.1% to about 20% $CO_2$, about 0.1% to about 30% $CO_2$, about 0.1% to about 40% $CO_2$, about 0.1% to about 50% $CO_2$, about 1% to about 5% $CO_2$, about 1% to about 10% $CO_2$, about 1% to about 20% $CO_2$, about 1% to about 30% $CO_2$, about 1% to about 40% $CO_2$, about 1% to about 50% $CO_2$, about 5% to about 10% $CO_2$, about 10% to about 20% $CO_2$, about 10% to about 30% $CO_2$, about 10% to about 40% $CO_2$, about 10% to about 50% $CO_2$, about 10% to about 60% $CO_2$, about 10% to about 70% $CO_2$, about 10% to about 80% $CO_2$, about 50% to about 60% $CO_2$, about 50% to about 70% $CO_2$, or about 50% to about 80% $CO_2$. Modified host cells disclosed herein disclosed herein can be grown under aerobic, anoxic, microaerobic, or anaerobic conditions based on the requirements of the cells.

Standard culture conditions and modes of fermentation, such as batch, fed-batch, or continuous fermentation that can be used are described in International Publication No. WO 2009/076676, U.S. patent application Ser. No. 12/335,071 (U.S. Publ. No. 2009/0203102), WO 2010/003007, US Publ. No. 2010/0048964, WO 2009/132220, US Publ. No. 2010/0003716, the contents of each of which are incorporated by reference herein in their entireties. Batch and Fed-Batch fermentations are common and well known in the art and examples can be found in Brock, Biotechnology: A Textbook of Industrial Microbiology, Second Edition (1989) Sinauer Associates, Inc.

Production and Recovery of Produced Cannabinoids or Cannabinoid Derivatives

The present disclosure provides for production of a cannabinoid or a cannabinoid derivative. In some embodiments, a method of the present disclosure provides for production of a cannabinoid or a cannabinoid derivative, such as those disclosed herein, by modified host cells of the disclosure in an amount of from about 1 mg/L culture medium to about 1 g/L culture medium. In some embodiments, a method of the present disclosure provides for production of a cannabinoid or a cannabinoid derivative in an amount of from about 1 mg/L culture medium to about 500 mg/L culture medium. In some embodiments, a method of the present disclosure provides for production of a cannabinoid or a cannabinoid derivative in an amount of from about 1 mg/L culture medium to about 100 mg/L culture medium. For example, in some embodiments, a method of the present disclosure provides for production of a cannabinoid or a cannabinoid derivative in an amount of from about 1 mg/L culture medium to about 5 mg/L culture medium, from about 5 mg/L culture medium to about 10 mg/L culture medium, from about 10 mg/L culture medium to about 25 mg/L culture medium, from about 25 mg/L culture medium to about 50 mg/L culture medium, from about 50 mg/L culture medium to about 75 mg/L culture medium, or from about 75 mg/L culture medium to about 100 mg/L culture medium. In some embodiments, a method of the present disclosure provides for production of a cannabinoid or a cannabinoid derivative in an amount of from about 100 mg/L culture medium to about 150 mg/L culture medium, from about 150 mg/L culture medium to about 200 mg/L culture medium, from about 200 mg/L culture medium to about 250 mg/L culture medium, from about 250 mg/L culture medium to about 500 mg/L culture medium, from about 500 mg/L culture medium to about 750 mg/L culture medium, or from about 750 mg/L culture medium to about 1 g/L culture medium. In some embodiments, a method of the present disclosure provides for production of a cannabinoid or a cannabinoid derivative in an amount of from about from about 50 mg/L culture medium to about 100 mg/L culture medium, 50 mg/L culture medium to about 150 mg/L culture medium, from about 50 mg/L culture medium to about 200 mg/L culture medium, from about 50 mg/L culture medium to about 250 mg/L culture medium, from about 50 mg/L culture medium to about 500 mg/L culture medium, or from about 50 mg/L culture medium to about 750 mg/L culture medium.

In some embodiments, a method of the present disclosure provides for production of a cannabinoid or a cannabinoid derivative, such as those disclosed herein, in an amount of from about 50 mg/L culture medium to about 100 g/L culture medium, or more than 100 g/L culture medium. In some embodiments, a method of the present disclosure provides for production of a cannabinoid or a cannabinoid derivative, such as those disclosed herein, in an amount of from about 50 mg/L culture medium to about 100 mg/L culture medium, or more than 100 mg/L culture medium. In some embodiments, a method of the present disclosure provides for production of a cannabinoid or a cannabinoid derivative, such as those disclosed herein, in an amount of more than 50 mg/L culture medium. In some embodiments, a method of the present disclosure provides for production of a cannabinoid or a cannabinoid derivative, such as those disclosed herein, in an amount of more than 100 mg/L culture medium. In some embodiments, a method of the present disclosure provides for production of a cannabinoid or a cannabinoid derivative in an amount of from about 100 mg/L culture medium to about 500 mg/L culture medium, or more than 500 mg/L culture medium. In some embodiments, a method of the present disclosure provides for production of a cannabinoid or a cannabinoid derivative in an amount of from about 500 mg/L culture medium to about 1 g/L culture medium, or more than 1 g/L culture medium. In some embodiments, a method of the present disclosure provides for production of a cannabinoid or a cannabinoid derivative in an amount of from about 1 g/L culture medium to about 10 g/L culture medium, or more than 10 g/L culture medium. In some embodiments, a method of the present disclosure provides for production of a cannabinoid or a cannabinoid derivative in an amount of from about 10 g/L culture medium to about 100 g/L culture medium, or more than 100 g/L culture medium. In some embodiments, a method of the present disclosure provides for production of a cannabinoid or a cannabinoid derivative in an amount of from about 1 g/L culture medium to about 20 g/L culture medium, or more than 20 g/L culture medium. In some embodiments, a method of the present disclosure provides for production of a cannabinoid or a cannabinoid derivative in an amount of from about 1 g/L culture medium to about 30 g/L culture medium, or more than 30 g/L culture medium. In some embodiments, a method of the present disclosure provides for production of a cannabinoid or a cannabinoid derivative in an amount of from about 1 g/L culture medium to about 40 g/L culture medium, or more than 40 g/L culture medium. In some embodiments, a method of the present disclosure provides for production of a cannabinoid or a cannabinoid derivative in an amount of from about 1 g/L culture medium to about 50 g/L culture medium, or more than 50 g/L culture medium. In some embodiments, a method of the present disclosure provides for production of a cannabinoid or a cannabinoid derivative in an amount of from about 1 g/L culture medium to about 60 g/L culture medium, or more than 60 g/L culture medium. In some embodiments, a method of the present disclosure provides for production of a cannabinoid or a cannabinoid derivative in an amount of from about 1 g/L culture medium to about 70 g/L culture medium, or more than 70 g/L culture medium. In some embodiments, a method of the present disclosure provides for production of a cannabinoid or a cannabinoid derivative in an amount of from about 1 g/L culture medium to about 80 g/L culture medium, or more than 80 g/L culture medium. In some embodiments, a method of the present disclosure provides for production of a cannabinoid or a cannabinoid derivative in an amount of from about 1 g/L culture medium to about 90 g/L culture medium, or more than 90 g/L culture medium. In some embodiments, a method of the present disclosure provides for production of a cannabinoid or a cannabinoid derivative in an amount of from about 10 g/L culture medium to about 20 g/L culture medium, or more than 20 g/L culture medium. In some embodiments, a method of the present disclosure provides for production of a cannabinoid or a cannabinoid derivative in an amount of from about 10 g/L culture medium to about 30 g/L culture medium, or more than 30 g/L culture medium. In some embodiments, a method of the present disclosure provides for production of a cannabinoid or a cannabinoid derivative in an amount of from about 10 g/L culture medium to about 40 g/L culture medium, or more than 40 g/L culture medium. In some embodiments, a method of the present disclosure provides for production of a cannabinoid or a cannabinoid derivative in an amount of from about 10 g/L culture medium to about 50 g/L culture medium, or more than 50 g/L culture medium. In some embodiments, a method of the present disclosure provides for production of a cannabinoid or a cannabinoid derivative in an amount of from about 10 g/L culture medium to about 60 g/L culture medium, or more than 60 g/L culture medium. In some embodiments, a method of the present disclosure provides for production of a cannabinoid or a cannabinoid derivative in an amount of from about 10 g/L culture medium to about 70 g/L culture medium, or more than 70 g/L culture medium. In some embodiments, a method of the present disclosure provides for production of a cannabinoid or a cannabinoid derivative in an amount of from about 10 g/L culture medium to about 80 g/L culture medium, or more than 80 g/L culture medium. In some embodiments, a method of the present disclosure provides for production of a cannabinoid or a cannabinoid derivative in an amount of from about 10 g/L culture medium to about 90 g/L culture medium, or more than 90 g/L culture medium. In some embodiments, a method of the present disclosure provides for production of a cannabinoid or a cannabinoid derivative in an amount of from about 50 g/L culture medium to about 100 g/L culture medium, or more than 100 g/L culture medium. In some embodiments, a method of the present disclosure provides for production of a cannabinoid or a cannabinoid derivative in an amount of from about 50 g/L culture medium to about 60 g/L culture medium, or more than 60 g/L culture medium. In some embodiments, a method of the present disclosure provides for production of a cannabinoid or a cannabinoid derivative in an amount of from about 50 g/L culture medium to about 70 g/L culture medium, or more than 70 g/L culture medium. In some embodiments, a method of the present disclosure provides for production of a cannabinoid or a cannabinoid derivative in an amount of from about 50 g/L culture medium to about 80 g/L culture medium, or more than 80 g/L culture medium. In some embodiments, a method of the present disclosure provides for production of a cannabinoid or a cannabinoid derivative in an amount of from about 50 g/L culture medium to about 90 g/L culture medium, or more than 90 g/L culture medium. In some embodiments, a method of the present disclosure provides for production of a cannabinoid or a cannabinoid derivative in an amount of from about 20 g/L culture medium to about 100 g/L culture medium, or more than 100 g/L culture medium. In some embodiments, a method of the present disclosure provides for production of a cannabinoid or a cannabinoid derivative in an amount of from about 20 g/L culture medium to about 30 g/L culture medium, or more than 30 g/L culture medium. In some embodiments, a method of the present disclosure provides for production of a cannabinoid or a cannabinoid derivative in an amount of from about 20 g/L culture medium to about 40 g/L culture medium, or more than 40 g/L culture medium. In some embodiments, a method of the present disclosure provides for production of a cannabinoid or a cannabinoid derivative in an amount of from about 20 g/L culture medium to about 50 g/L culture medium, or more than 50 g/L culture medium. In some embodiments, a method of the present disclosure provides for production of a cannabinoid or a cannabinoid derivative in an amount of from about 20 g/L culture medium to about 60 g/L culture medium, or more than 60 g/L culture medium. In some embodiments, a method of the present disclosure provides for production of a cannabinoid or a cannabinoid derivative in an amount of from about 20 g/L culture medium to about 70 g/L culture medium, or more than 70 g/L culture medium. In some embodiments, a method of the present disclosure provides for production of a cannabinoid or a cannabinoid derivative in an amount of from about 20 g/L culture medium to about 80 g/L culture medium, or more than 80 g/L culture medium. In some embodiments, a method of the present disclosure provides for production of a cannabinoid or a cannabinoid derivative in an amount of from about 20 g/L culture medium to about 90 g/L culture medium, or more than 90 g/L culture medium.

In some embodiments, the modified host cell disclosed herein is cultured in a liquid medium comprising a carboxylic acid, olivetolic acid, or an olivetolic acid derivative.

In some embodiments, a method of producing a cannabinoid or a cannabinoid derivative, such as those disclosed herein, may involve culturing a modified yeast cell of the present disclosure under conditions that favor production of a cannabinoid or a cannabinoid derivative; wherein the cannabinoid or the cannabinoid derivative is produced by the modified yeast cell and is present in the culture medium (e.g., a liquid culture medium) in which the modified yeast cell is cultured. In some embodiments, the culture medium in which the modified yeast cell is cultured comprises a cannabinoid or a cannabinoid derivative in an amount of from 1 ng/L to 1 g/L (e.g., from 1 ng/L to 50 ng/L, from 50 ng/L to 100 ng/L, from 100 ng/L to 500 ng/L, from 500 ng/L to 1 μg/L, from 1 μg/L to 50 μg/L, from 50 μg/L to 100 μg/L, from 100 μg/L to 500 μg/L, from 500 μg/L to 1 mg/L, from 1 mg/L to 50 mg/L, from 50 mg/L to 100 mg/L, from 100 mg/L to 500 mg/L, or from 500 mg/L to 1 g/L). In certain such embodiments, the modified yeast cell is a modified *S. cerevisiae*. In some embodiments, the culture medium in which the modified yeast cell is cultured comprises a cannabinoid or a cannabinoid derivative in an amount from 50 mg/L to 100 mg/L. In certain such embodiments, the modified yeast cell is a modified *S. cerevisiae*. In some embodiments, the culture medium in which the modified yeast cell is cultured comprises a cannabinoid or a cannabinoid derivative in an amount from 100 mg/L to 500 mg/L. In certain such embodiments, the modified yeast cell is a modified *S. cerevisiae*. In some embodiments, the culture medium in which the modified yeast cell is cultured comprises a cannabinoid or a cannabinoid derivative in an amount from 500 mg/L to 1 g/L. In certain such embodiments, the modified yeast cell is a modified *S. cerevisiae*. In some embodiments, the culture medium in which the modified yeast cell is cultured comprises a cannabinoid or a cannabinoid derivative in an amount more than 1 g/L. In certain such embodiments, the modified yeast cell is a modified *S. cerevisiae*.

In some embodiments, a method of producing a cannabinoid or a cannabinoid derivative, such as those disclosed herein, may involve culturing a modified yeast cell of the present disclosure under conditions that favor fermentation of a sugar, and under conditions that favor production of a cannabinoid or a cannabinoid derivative; wherein the cannabinoid or the cannabinoid derivative is produced by the modified yeast cell and is present in alcohol produced by the modified yeast cell. The present disclosure provides an alcoholic beverage produced by the modified yeast cell, where the alcoholic beverage comprises the cannabinoid or cannabinoid derivative produced by the modified yeast cell. Alcoholic beverages may include beer, wine, and distilled alcoholic beverages. In some embodiments, an alcoholic beverage of the present disclosure comprises a cannabinoid or a cannabinoid derivative in an amount of from 1 ng/L to 1 g/L (e.g., from 1 ng/L to 50 ng/L, from 50 ng/L to 100 ng/L, from 100 ng/L to 500 ng/L, from 500 ng/L to 1 μg/L, from 1 μg/L to 50 μg/L, from 50 μg/L to 100 μg/L, from 100 μg/L to 500 μg/L, from 500 μg/L to 1 mg/L, from 1 mg/L to 50 mg/L, from 50 mg/L to 100 mg/L, from 100 mg/L to 500 mg/L, or from 500 mg/L to 1 g/L). In some embodiments, an alcoholic beverage of the present disclosure comprises a cannabinoid or a cannabinoid derivative in an amount more than 1 g/L.

The present disclosure provides a beverage produced by the modified yeast cell, where the beverage comprises the cannabinoid or cannabinoid derivative, such as those disclosed herein, produced by the modified yeast cell. In some embodiments, a beverage of the present disclosure comprises a cannabinoid or a cannabinoid derivative in an amount of from 1 ng/L to 1 g/L (e.g., from 1 ng/L to 50 ng/L, from 50 ng/L to 100 ng/L, from 100 ng/L to 500 ng/L, from 500 ng/L to 1 μg/L, from 1 μg/L to 50 μg/L, from 50 μg/L to 100 μg/L, from 100 μg/L to 500 μg/L, from 500 μg/L to 1 mg/L, from 1 mg/L to 50 mg/L, from 50 mg/L to 100 mg/L, from 100 mg/L to 500 mg/L, or from 500 mg/L to 1 g/L). In some embodiments, a beverage of the present disclosure comprises a cannabinoid or a cannabinoid derivative in an amount more than 1 g/L. In some embodiments, a beverage of the present disclosure is non-alcoholic.

In some embodiments, a method of the present disclosure provides for increased production of a cannabinoid or a cannabinoid derivative, such as those disclosed herein. In certain such embodiments, culturing of the modified host cell disclosed herein in a culture medium provides for synthesis of a cannabinoid or a cannabinoid derivative in an increased amount compared to an unmodified host cell cultured under similar conditions. The production of a cannabinoid or a cannabinoid derivative by the modified host cells disclosed herein may be increased by about 5% to about 1,000,000 folds compared to an unmodified host cell cultured under similar conditions. The production of a cannabinoid or a cannabinoid derivative by the modified host cells disclosed herein may be increased by about 10% to about 1,000,000 folds (e.g., about 50% to about 1,000,000 folds, about 1 to about 500,000 folds, about 1 to about 50,000 folds, about 1 to about 5,000 folds, about 1 to about 1,000 folds, about 1 to about 500 folds, about 1 to about 100 folds, about 1 to about 50 folds, about 5 to about 100,000 folds, about 5 to about 10,000 folds, about 5 to about 1,000 folds, about 5 to about 500 folds, about 5 to about 100 folds, about 10 to about 50,000 folds, about 50 to about 10,000 folds, about 100 to about 5,000 folds, about 200 to about 1,000 folds, about 50 to about 500 folds, or about 50 to about 200 folds) compared to the production of a cannabinoid or a cannabinoid derivative by unmodified host cells cultured under similar conditions. The production of a cannabinoid or a cannabinoid derivative by modified host cells disclosed herein may also be increased by at least about any of 10%, 20%, 30%, 40%, 50%, 60%, 70%, 80%, 90%, 100%, 1 fold, 2 folds, 5 folds, 10 folds, 20 folds, 50 folds, 100 folds, 200 folds, 500 folds, 1000 folds, 2000 folds, 5000 folds, 10,000 folds, 20,000 folds, 50,000 folds, 100,000 folds, 200,000 folds, 500,000 folds, or 1,000,000 folds or more compared to the production of a cannabinoid or a cannabinoid derivative by unmodified host cells cultured under similar conditions.

In some embodiments, the production of a cannabinoid or a cannabinoid derivative, such as those disclosed herein, by modified host cells of the disclosure may also be increased by at least about any of 10%, 20%, 30%, 40%, 50%, 60%, 70%, 80%, 90%, or 100% compared to the production of a cannabinoid or a cannabinoid derivative by unmodified host cells cultured under similar conditions. In some embodiments, the production of a cannabinoid or a cannabinoid derivative by modified host cells disclosed herein may also be increased by at least about any of 1-20%, 2-20%, 5-20%, 10-20%, 15-20%, 1-15%, 1-10%, 2-15%, 2-10%, 5-15%, 10-15%, 1-50%, 10-50%, 20-50%, 30-50%, 40-50%, 50-100%, 50-60%, 50-70%, 50-80%, 50-90%, or 50-100% compared to the production of a cannabinoid or a cannabinoid derivative by unmodified host cells cultured under similar conditions.

In some embodiments, production of a cannabinoid or a cannabinoid derivative by modified host cells of the disclosure is determined by LC-MS analysis. In certain such embodiments, each cannabinoid or cannabinoid derivative is identified by retention time, determined from an authentic standard, and multiple reaction monitoring (MRM) transition.

In some embodiments, the modified host cell of the disclosure is a yeast cell. In certain such embodiments, the modified host cell disclosed herein is cultured in a bioreactor. In some embodiments, the modified host cell is cultured in a culture medium supplemented with unsubstituted or substituted hexanoic acid, a carboxylic acid other than unsubstituted or substituted hexanoic acid, olivetolic acid, or an olivetolic acid derivative. In some embodiments, the modified yeast cell is a modified *S. cerevisiae.*

In some embodiments, the cannabinoid or cannabinoid derivative, such as those disclosed herein, is recovered from a cell lysate, e.g., by lysing the modified host cell disclosed herein and recovering the cannabinoid or cannabinoid derivative from the lysate. In other cases, the cannabinoid or cannabinoid derivative is recovered from the culture medium in which the modified host cell disclosed herein is cultured. In other cases, the cannabinoid or cannabinoid derivative is recovered from both the cell lysate and the culture medium. In other cases, the cannabinoid or cannabinoid derivative is recovered from a modified host cell. In other cases, the cannabinoid or cannabinoid derivative is recovered from both the modified host cell and the culture medium. In other cases, the cannabinoid or cannabinoid derivative is recovered from the cell lysate, the modified host cell, and the culture medium. In some embodiments when the cannabinoid or cannabinoid derivative is recovered from a cell lysate; from a culture medium; from a modified host cell; from both the cell lysate and the culture medium; from both the modified host cell and the culture medium; or from the cell lysate, the modified host cell, and the culture medium, the recovered cannabinoid or cannabinoid derivative is in the form of a salt. In certain such embodiments, the salt is a pharmaceutically acceptable salt. In some embodiments, the salt of the recovered cannabinoid or cannabinoid derivative is then purified as disclosed herein.

In some embodiments, the recovered cannabinoid or cannabinoid derivative, such as those disclosed herein, is then purified. In some embodiments, whole-cell broth from cultures comprising modified host cells of the disclosure may be extracted with a suitable organic solvent to afford cannabinoids or cannabinoid derivatives. Suitable organic solvents include, but are not limited to, hexane, heptane, ethyl acetate, petroleum ether, and di-ethyl ether, chloroform, and ethyl acetate. In some embodiments, the suitable organic solvent comprises hexane. In some embodiments, the suitable organic solvent may be added to the whole-cell broth from fermentations comprising modified host cells of the disclosure at a 10:1 ratio (10 parts whole-cell broth−1 part organic solvent) and stirred for 30 minutes. In certain such embodiments, the organic fraction may be separated and extracted twice with an equal volume of acidic water (pH 2.5). The organic layer may then be separated and dried in a concentrator (rotary evaporator or thin film evaporator under reduced pressure) to obtain crude cannabinoid or cannabinoid derivative crystals. In certain such embodiments, the crude crystals may be heated or exposed to light to decarboxylate the crude cannabinoid or cannabinoid derivative. In certain such embodiments, the crude crystals may be heated to 105° C. for 15 minutes followed by 145° C. for 55 minutes to decarboxylate the crude cannabinoid or cannabinoid derivative. In certain such embodiments, the crude crystalline product may be re-dissolved and recrystallized in a suitable solvent (e.g., n-pentane) and filtered to remove any insoluble material. In certain such embodiments, the solvent may then be removed e.g., by rotary evaporation, to produce pure crystalline product.

In some embodiments, the cannabinoid or cannabinoid derivative is pure, e.g., at least about 40% pure, at least about 50% pure, at least about 60% pure, at least about 70% pure, at least about 80% pure, at least about 90% pure, at least about 95% pure, at least about 98%, or more than 98% pure, where "pure" in the context of a cannabinoid or a cannabinoid derivative may refer to a cannabinoid or a cannabinoid derivative that is free from other cannabinoids or cannabinoid derivatives, macromolecules, contaminants, etc.

Methods of Preparing Engineered Variants of a Cannabidiolic Acid Synthase (CBDAS) Polypeptide In an aspect, the present disclosure provides methods for preparing engineered variants of a cannabidiolic acid synthase (CBDAS) polypeptide. In certain such embodiments, the methods may comprise culturing a modified host cell of the disclosure in a culture medium. In some embodiments, the modified host cell of the disclosure is a *Pichia* sp. The method can comprise isolating and/or purifying the expressed engineered variants, as described herein.

In some embodiments, the method for preparing engineered variants comprises the step of isolating or purifying the engineered variants. The engineered variants of the disclosure can be expressed in modified host cells, as described herein, and isolated from the modified host cells and/or culture medium using any one or more of the well known techniques used for protein purification, including, among others, lysozyme treatment, sonication, filtration, salting-out, ultra-centrifugation, and chromatography. Chromatographic techniques for isolation of the engineered variants of the disclosure may include, among others, reverse phase chromatography high performance liquid chromatography, ion exchange chromatography, gel electrophoresis, and affinity chromatography. In some embodiments, affinity chromatography is used.

In some embodiments, the engineered variants of the disclosure expressed in the modified host cells of the disclosure can be prepared and used in various forms including but not limited to crude extracts (e.g., cell-free lysates), powders (e.g., shake-flask powders), lyophilizates, frozen stocks made with glycerol or another cryoprotectant, and substantially pure preparations (e.g., DSP powders).

In some embodiments, the engineered variants of the disclosure expressed in the modified host cells of the disclosure can be prepared and used in purified form. Generally, conditions for purifying a particular engineered variant will depend, in part, on factors such as net charge, hydrophobicity, hydrophilicity, molecular weight, molecular shape, etc., and will be apparent to those having skill in the art.

Cell-Free Methods of Producing Cannabinoids or Cannabinoid Derivatives

The methods of the disclosure may involve cell-free production of cannabinoids or cannabinoid derivatives, such as those disclosed herein, using engineered variants disclosed herein expressed or overexpressed by a modified host cell of the disclosure. In some embodiments, an engineered variant disclosed herein is used in a cell-free system for the production of cannabinoids or cannabinoid derivatives. In certain such embodiments, the engineered variant of the disclosure is isolated and/or purified. In some embodiments, appropriate starting materials for use in producing cannabinoids or cannabinoid derivatives may be mixed together with engineered variants disclosed herein in a suitable reaction vessel to effect the reaction. The engineered variants disclosed herein may be used in combination to effect a complete synthesis of a cannabinoid or cannabinoid derivative from the appropriate starting materials. In some embodiments, the cannabinoid or cannabinoid derivative is recovered from a cell-free reaction mixture comprising engineered disclosed herein.

In some embodiments, the recovered cannabinoids or cannabinoid derivatives, such as those disclosed herein, are then purified. In certain such embodiments, a cell-free reaction mixture comprising an engineered variant disclosed herein may be extracted with a suitable organic solvent to afford cannabinoids or cannabinoid derivatives. Suitable organic solvents include, but are not limited to, hexane, heptane, ethyl acetate, petroleum ether, and di-ethyl ether, chloroform, and ethyl acetate. In some embodiments, the suitable organic solvent comprises hexane. In some embodiments, the suitable organic solvent may be added to the cell-free reaction mixture comprising one or more of the polypeptides disclosed herein at a 10:1 ratio (10 parts reaction mixture–1 part organic solvent) and stirred for 30 minutes. In certain such embodiments, the organic fraction may be separated and extracted twice with an equal volume of acidic water (pH 2.5). The organic layer may then be separated and dried in a concentrator (rotary evaporator or thin film evaporator under reduced pressure) to obtain crude cannabinoid or cannabinoid derivative crystals. In certain such embodiments, the crude crystals may be heated or exposed to light to decarboxylate the crude cannabinoid or cannabinoid derivative. In certain such embodiments, the crude crystals may be heated to 105° C. for 15 minutes followed by 145° C. for 55 minutes to decarboxylate the crude cannabinoid or cannabinoid derivative. In certain such embodiments, the crude crystalline product may be re-dissolved and recrystallized in a suitable solvent (e.g., n-pentane) and filtered to remove any insoluble material. In certain such embodiments, the solvent may then be removed e.g., by rotary evaporation, to produce pure crystalline product.

In some embodiments when the cannabinoid or cannabinoid derivative is recovered from a cell-free reaction mixture comprising one or more engineered variants disclosed herein, the recovered cannabinoid or cannabinoid derivative is in the form of a salt. In certain such embodiments, the salt is a pharmaceutically acceptable salt. In some embodiments, the salt of the recovered cannabinoid or cannabinoid derivative is then purified as disclosed herein.

In some embodiments, cell-free production of a cannabinoid or a cannabinoid derivative by engineered variants disclosed herein is determined by LC-MS analysis. In certain such embodiments, each cannabinoid or cannabinoid derivative is identified by retention time, determined from an authentic standard, and multiple reaction monitoring (MRM) transition.

In some embodiments when the cannabinoid or cannabinoid derivative is recovered from a cell-free reaction mixture comprising one or more polypeptides and/or engineered variants disclosed herein, the recovered cannabinoid or cannabinoid derivative is in the form of a salt. In certain such embodiments, the salt is a pharmaceutically acceptable salt. In some embodiments, the salt of the recovered cannabinoid or cannabinoid derivative is then purified as disclosed herein.

Examples of Non-Limiting Embodiments of the Disclosure

Embodiments of the present subject matter disclosed herein may be beneficial alone or in combination with one or more other embodiments. Without limiting the foregoing description, certain non-limiting embodiments of the disclosure, numbered I-1 to I-132 are provided below. As will be apparent to those of skill in the art upon reading this disclosure, each of the individually numbered embodiments may be used or combined with any of the preceding or following individually numbered embodiments. This is intended to provide support for all such combinations of embodiments and is not limited to combinations of embodiments explicitly provided below.

Some embodiments of the disclosure are of Embodiment I:

Embodiment I-1. An engineered variant of a cannabidiolic acid synthase (CBDAS) polypeptide comprising an amino acid sequence of SEQ ID NO:3 with one or more amino acid substitutions.

Embodiment I-2. The engineered variant of Embodiment I-1, wherein the engineered variant comprises an amino acid sequence with at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to SEQ ID NO:3.

Embodiment I-3. The engineered variant of Embodiment I-1 or I-2, wherein the engineered variant comprises at least one amino acid substitution in a signal polypeptide, a flavin adenine dinucleotide (FAD) binding domain, a berberine bridge enzyme (BBE) domain, or a combination of the foregoing.

Embodiment I-4. The engineered variant of Embodiment I-3, wherein the engineered variant comprises at least one amino acid substitution in the signal polypeptide.

Embodiment I-5. The engineered variant of Embodiment I-3 or I-4, wherein the engineered variant comprises at least one amino acid substitution in the FAD binding domain.

Embodiment I-6. The engineered variant of any one of Embodiments I-3 to I-5, wherein the engineered variant comprises at least one amino acid substitution in the BBE domain.

Embodiment I-7. The engineered variant of any one of Embodiments I-3 to I-6, wherein the engineered variant comprises substitution of at least one surface exposed amino acid.

Embodiment I-8. The engineered variant of Embodiment I-1 or I-2, wherein the engineered variant comprises at least one amino acid substitution at an amino acid selected from the group consisting of C12, F17, F18, S20, R31, N33, P43, L49, K50, L51, Q55, N56, N57, L59, M61, S62, V63, S66, L71, S75, I97, L98, S100, V103, T109, Q124, V125, I129, L132, S137, H143, V149, W161, K165, E167, N168, S170, L171, A172, Y175, C180, A181, N196, H208, A235, A250, M256, K260, L268, H309, T310, F316, L326, G378, K389, E406, S428, L439, N466, K474, Y499, N527, P538, R541, H542, R543, and H544.

Embodiment I-9. The engineered variant of Embodiment I-8, wherein the engineered variant comprises at least one amino acid substitution at an amino acid selected from the group consisting of R31, P43, L49, K50, L51, Q55, N56, N57, M61, S62, L71, I97, S100, V103, T109, Q124, V125, I129, L132, S137, H143, V149, W161, K165, E167, N168, S170, L171, A172, Y175, C180, A181, N196, H208, A235, A250, M256, K260, L268, H309, T310, F316, L326, G378, K389, S428, L439, N466, K474, Y499, N527, P538, R541, H542, R543, and H544.

Embodiment I-10. The engineered variant of Embodiment I-8 or I-9, wherein the engineered variant comprises at least one amino acid substitution at an amino acid selected from the group consisting of L49, K50, N56, N57, V125, L132, V149, W161, K165, S170, L171, A172, N196, A235, K260, L268, T310, F316, L326, G378, S428, Y499, N527, H543, and H544.

Embodiment I-11. The engineered variant of Embodiment I-8 or I-9, wherein the engineered variant comprises at least one amino acid substitution at an amino acid selected from the group consisting of R541, H542, R543, and H544.

Embodiment I-12. The engineered variant of Embodiment I-1 or I-2, wherein the engineered variant comprises at least one amino acid substitution at an amino acid selected from the group consisting of R31, N57, M61, L71, S170, A172, Y175, N196, H208, A235, K260, G378, K389, and R543.

Embodiment I-13. The engineered variant of Embodiment I-12, wherein the engineered variant comprises at least one amino acid substitution at an amino acid selected from the group consisting of N57, S170, A172, N196, A235, K260, and G378.

Embodiment I-14. The engineered variant of Embodiment I-1 or I-2, wherein the engineered variant comprises at least one amino acid substitution selected from the group consisting of C12F, F17M, F18T, F18W, S20G, R31Q, N33K, P43E, L49E, L49K, L49Q, K50T, L51I, Q55E, Q55P, N56E, N57D, N57E, L59E, M61H, M61S, M61W, S62N, S62Q, V63M, S66D, L71A, L71H, L71Q, S75D, S75E, I97V, L98V, S100A, V103A, V103F, T109V, Q124D, Q124E, Q124N, V125E, V125Q, I129V, L132M, S137G, H143D, V149I, W161K, W161R, W161Y, K165A, E167P, N168S, S170T, L171I, A172V, Y175F, C180A, A181V, N196Q, N196T, N196V, H208T, A235P, A250T, M256V, K260C, K260W, L268I, H309V, T310A, T310C, F316Y, L326I, G378T, G378S, K389E, E406K, S428L, L439M, N466D, K474S, Y499M, Y499V, N527E, P538T, R541E, R541V, H542V, R543A, R543E, H544E, and H544D.

Embodiment I-15. The engineered variant of Embodiment I-14, wherein the engineered variant comprises at least one amino acid substitution selected from the group consisting of R31Q, P43E, L49E, L49K, L49Q, K50T, L51I, Q55E, Q55P, N56E, N57D, M61H, M61S, M61W, S62Q, L71A, L71Q, I97V, S100A, V103A, V103F, T109V, Q124D, Q124E, Q124N, V125E, V125Q, I129V, L132M, S137G, H143D, V149I, W161K, W161R, W161Y, K165A, E167P, N168S, S170T, L171I, A172V, Y175F, C180A, A181V, N196Q, N196T, N196V, H208T, A235P, A250T, M256V, K260C, K260W, L268I, H309V, T310A, T310C, F316Y, L326I, G378T, G378S, K389E, S428L, L439M, N466D, K474S, Y499M, Y499V, N527E, P538T, R541E, R541V, H542V, R543A, R543E, H544E, and H544D.

Embodiment I-16. The engineered variant of Embodiment I-14 or I-15, wherein the engineered variant comprises at least one amino acid substitution selected from the group consisting of L49E, L49Q, K50T, N56E, N57D, V125E, L132M, V149I, W161R, K165A, S170T, L171I, A172V, N196Q, N196T, N196V, A235P, K260W, K260C, L268I, T310A, T310C, F316Y, L326I, G378T, S428L, Y499M, Y499V, N527E, H543E, and H544E.

Embodiment I-17. The engineered variant of Embodiment I-14 or I-15, wherein the engineered variant comprises at least one amino acid substitution selected from the group consisting of R541E, R541V, H542V, R543A, R543E, H544E, and H544D.

Embodiment I-18. The engineered variant of Embodiment I-1 or I-2, wherein the engineered variant comprises at least one amino acid substitution selected from the group consisting of R31Q, N57D, M61W, L71H, S170T, A172V, Y175F, N196V, H208T, A235P, K260W, G378T, K389E, and R543E.

Embodiment I-19. The engineered variant of Embodiment I-18, wherein the engineered variant comprises at least one amino acid substitution selected from the group consisting of N57D, S170T, A172V, N196V, A235P, K260W, and G378T.

Embodiment I-20. The engineered variant of Embodiment I-1 or I-2, wherein the engineered variant comprises an amino acid sequence selected from the group consisting of SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, and SEQ ID NO:234.

Embodiment I-21. The engineered variant of Embodiment I-20, wherein the engineered variant comprises an amino acid sequence selected from the group consisting of SEQ ID NO:60, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:88, SEQ ID NO:90, SEQ ID NO:92, SEQ ID NO:96, SEQ ID NO:102, SEQ ID NO:106, SEQ ID NO:112, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, and SEQ ID NO:234.

Embodiment I-22. The engineered variant of Embodiment I-20 or I-21, wherein the engineered variant comprises an amino acid sequence selected from the group consisting of SEQ ID NO:66, SEQ ID NO:70, SEQ ID NO:72, SEQ ID NO:80, SEQ ID NO:82, SEQ ID NO:130, SEQ ID NO:136, SEQ ID NO:142, SEQ ID NO:146, SEQ ID NO:150, SEQ ID NO:156, SEQ ID NO:158, SEQ ID NO:160, SEQ ID NO:168, SEQ ID NO:170, SEQ ID NO:172, SEQ ID NO:176, SEQ ID NO:182, SEQ ID NO:184, SEQ ID NO:186, SEQ ID NO:190, SEQ ID NO:192, SEQ ID NO:194, SEQ ID NO:196, SEQ ID NO:198, SEQ ID NO:206, SEQ ID NO:214, SEQ ID NO:216, SEQ ID NO:218, SEQ ID NO:230, and SEQ ID NO:232.

Embodiment I-23. The engineered variant of Embodiment I-20 or I-21, wherein the engineered variant comprises an amino acid sequence selected from the group consisting of SEQ ID NO:222, SEQ ID NO:224, SEQ ID NO:226, SEQ ID NO:228, SEQ ID NO:230, SEQ ID NO:232, and SEQ ID NO:234.

Embodiment I-24. The engineered variant of Embodiment I-1 or I-2, wherein the engineered variant comprises an amino acid sequence selected from the group consisting of SEQ ID NO:60, SEQ ID NO:82, SEQ ID NO:92, SEQ ID NO:104, SEQ ID NO:156, SEQ ID NO:160, SEQ ID NO:162, SEQ ID NO:172, SEQ ID NO:174, SEQ ID NO:176, SEQ ID NO:184, SEQ ID NO:198, SEQ ID NO:202, and SEQ ID NO:230.

Embodiment I-25. The engineered variant of Embodiment I-24, wherein the engineered variant comprises an amino acid sequence selected from the group consisting of SEQ ID NO:82, SEQ ID NO:156, SEQ ID NO:160, SEQ ID NO:172, SEQ ID NO:176, SEQ ID NO:184, and SEQ ID NO:198.

Embodiment I-26. The engineered variant of any one of Embodiments I-1 to I-19, wherein the engineered variant comprises an amino acid sequence of SEQ ID NO:3 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, or at least 30 amino acid substitutions.

Embodiment I-27. The engineered variant of any one of Embodiments I-1 to I-26, wherein the engineered variant comprises at least one immutable amino acid in a flavin adenine dinucleotide (FAD) binding domain, a berberine bridge enzyme (BBE) domain, or a combination of the foregoing.

Embodiment I-28. The engineered variant of Embodiment I-27, wherein the engineered variant comprises at least one immutable amino acid in the FAD binding domain.

Embodiment I-29. The engineered variant of Embodiment I-28, wherein the engineered variant comprises at least 1, at least 2, at least 3, at least 4, at least 5, at least 6, at least 7, at least 8, at least 9, at least 10, at least 11, at least 12, at least 13, at least 14, or at least 15 immutable amino acids in the FAD binding domain.

Embodiment I-30. The engineered variant of any one of Embodiments I-27 to I-29, wherein the engineered variant comprises at least one immutable amino acid in the BBE domain.

Embodiment I-31. The engineered variant of Embodiment I-30, wherein the engineered variant comprises at least 1, at least 2, at least 3, at least 4, at least 5, at least 6, at least 7, at least 8, at least 9, at least 10, at least 11, at least 12, at least 13, at least 14, or at least 15 immutable amino acids in the BBE domain.

Embodiment I-32. The engineered variant of any one of Embodiments I-1 to I-19, wherein the engineered variant comprises at least one immutable amino acid selected from the group consisting of A28, F34, L35, C37, L64, N70, P87, I93, C99, R108, R110, G112, E117, G118, 5120, P126, F127, D131, D141, W148, G152, A153, L155, G156, E157, Y159, Y160, N163, A173, G174, C176, P177, T178, V179, G182, G183, H184, F185, G187, G188, G189, Y190, G191, P192, L193, R195, A201, D202, I205, D206, V210, G214, G223, D225, L226, F227, W228, R231, G234, 5237, F238, G239, K245, I246, L248, V251, V259, Q276, F312, 5313, L323, C341, F352, 5354, F380, K381, I382, K383, D385, Y386, 1391, M412, L415, G419, M422, I425, I430, P431, P433, H434, R435, G437, Y440, W443, Y444, I445, I464, Y465, M468, T469, Y471, V472, P476, R484, N498, A502, N513, F514, K521, N528, F529, E533, Q534, and S535.

Embodiment I-33. The engineered variant of Embodiment I-32, wherein the engineered variant comprises at least one immutable amino acid selected from the group consisting of C37, N70, I93, C99, E117, 5120, F127, D131, G156, E157, Y159, G174, C176, G182, G183, F185, G187, G188, G189, Y190, G191, P192, R195, D202, D206, G214, W228, G234, F238, L248, Q276, 5313, L323, 5354, K381, K383, D385, G419, M422, R435, Y440, W443, Y444, Y471, P476, N513, F514, N528, and Q534.

Embodiment I-34. The engineered variant of any one of Embodiments I-1 to I-33, wherein the engineered variant comprises at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, or at least 25 immutable amino acids.

Embodiment I-35. The engineered variant of any one of Embodiments I-1 to I-34, wherein the engineered variant produces cannabidiolic acid (CBDA) from cannabigerolic acid (CBGA) in a greater amount, as measured in mg/L or mM, than an amount of CBDA produced from CBGA by a cannabidiolic acid synthase polypeptide having an amino acid sequence of SEQ ID NO:3 under similar conditions for the same length of time.

Embodiment I-36. The engineered variant of any one of Embodiments I-1 to I-35, wherein the engineered variant produces cannabidiolic acid (CBDA) from cannabigerolic acid (CBGA) in an amount, as measured in mg/L or mM, at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% greater than an amount of CBDA produced from CBGA by a cannabidiolic acid synthase polypeptide having an amino acid sequence of SEQ ID NO:3 under similar conditions for the same length of time.

Embodiment I-37. The engineered variant of any one of Embodiments I-1 to I-36, wherein the engineered variant produces cannabidiolic acid (CBDA) from cannabigerolic acid (CBGA) in an increased ratio of CBDA over tetrahydrocannabinolic acid (THCA) compared to that produced by a cannabidiolic acid synthase polypeptide having an amino acid sequence of SEQ ID NO:3 under similar conditions for the same length of time.

Embodiment I-38. The engineered variant of any one of Embodiments I-1 to I-37, wherein the engineered variant produces CBDA from CBGA in a ratio of CBDA over THCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

Embodiment I-39. The engineered variant of any one of Embodiments I-1 to I-19 or I-26 to I-38, wherein the engineered variant comprises a truncation at an N-terminus, at a C-terminus, or at both the N- and C-termini.

Embodiment I-40. The engineered variant of Embodiment I-39, wherein the truncated engineered variant comprises a signal polypeptide or a membrane anchor.

Embodiment I-41. The engineered variant of Embodiment I-39 or I-40, wherein the engineered variant lacks a native signal polypeptide.

Embodiment I-42. The engineered variant of any one of Embodiments I-39 to I-41, wherein the engineered variant comprises a truncation of at least 1, at least 2, at least 3, at least 4, at least 5, at least 6, at least 7, at least 8, at least 9, or at least 10 amino acids at the C-terminus.

Embodiment I-43. A nucleic acid comprising a nucleotide sequence encoding an engineered variant of any one of Embodiments I-1 to I-42.

Embodiment I-44. A nucleic acid comprising a nucleotide sequence encoding an engineered variant of a cannabidiolic acid synthase (CBDAS) polypeptide comprising an amino acid sequence of SEQ ID NO:3 with one or more amino acid substitutions, wherein the nucleotide sequence is selected from the group consisting of SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, and SEQ ID NO:233.

Embodiment I-45. The nucleic acid of Embodiment I-43 or I-44, wherein the nucleotide sequence is codon-optimized.

Embodiment I-46. A method of making a modified host cell for producing a cannabinoid or a cannabinoid derivative, the method comprising introducing one or more nucleic acids of any one of Embodiments I-43 to I-45 into a host cell.

Embodiment I-47. A vector comprising one or more nucleic acids of any one of Embodiments I-43 to I-45.

Embodiment I-48. A method of making a modified host cell for producing a cannabinoid or a cannabinoid derivative, the method comprising introducing one or more vectors of Embodiment I-47 into a host cell.

Embodiment I-49. A modified host cell for producing a cannabinoid or a cannabinoid derivative, wherein the modified host cell comprises one or more nucleic acids of any one of Embodiments I-43 to I-45.

Embodiment I-50. The modified host cell of Embodiment I-49, wherein the modified host cell comprises one or more heterologous nucleic acids comprising a nucleotide sequence encoding a geranyl pyrophosphate:olivetolic acid geranyltransferase (GOT) polypeptide.

Embodiment I-51. The modified host cell of Embodiment I-50, wherein the GOT polypeptide comprises an amino acid sequence having at least 85% sequence identity to SEQ ID NO:17.

Embodiment I-52. The modified host cell of Embodiment I-50 or I-51, wherein the modified host cell comprises two or more heterologous nucleic acids comprising the nucleotide sequence encoding the GOT polypeptide.

Embodiment I-53. The modified host cell of Embodiment I-49, wherein the modified host cell comprises one or more heterologous nucleic acids comprising a nucleotide sequence encoding a NphB polypeptide.

Embodiment I-54. The modified host cell of Embodiment I-53, wherein the NphB polypeptide comprises an amino acid sequence having at least 85% sequence identity to SEQ ID NO:294.

Embodiment I-55. The modified host cell of any one of Embodiments I-49 to I-54, wherein the modified host cell comprises one or more heterologous nucleic acids comprising a nucleotide sequence encoding a tetraketide synthase (TKS) polypeptide and one or more heterologous nucleic acids comprising a nucleotide sequence encoding an olivetolic acid cyclase (OAC) polypeptide.

Embodiment I-56. The modified host cell of Embodiment I-55, wherein the TKS polypeptide comprises an amino acid sequence having at least 85% sequence identity to SEQ ID NO:19.

Embodiment I-57. The modified host cell of Embodiment I-55 or I-56, wherein the modified host cell comprises three or more heterologous nucleic acids comprising a nucleotide sequence encoding a TKS polypeptide.

Embodiment I-58. The modified host cell of any one of Embodiments I-55 to I-57, wherein the OAC polypeptide comprises an amino acid sequence having at least 85% sequence identity to SEQ ID NO:21 or SEQ ID NO:48.

Embodiment I-59. The modified host cell of any one of Embodiments I-55 to I-58, wherein the modified host cell comprises three or more heterologous nucleic acids comprising a nucleotide sequence encoding an OAC polypeptide.

Embodiment I-60. The modified host cell of any one of Embodiments I-49 to I-59, wherein the modified host cell comprises one or more heterologous nucleic acids comprising a nucleotide sequence encoding an acyl-activating enzyme (AAE) polypeptide.

Embodiment I-61. The modified host cell of Embodiment I-60, wherein the AAE polypeptide comprises an amino acid sequence having at least 85% sequence identity to SEQ ID NO:23.

Embodiment I-62. The modified host cell of Embodiment I-60 or I-61, wherein the modified host cell comprises two or more heterologous nucleic acids comprising a nucleotide sequence encoding an AAE polypeptide.

Embodiment I-63. The modified host cell of any one of Embodiments I-49 to I-62, wherein the modified host cell comprises one or more of the following: a) one or more heterologous nucleic acids comprising a nucleotide sequence encoding a HMG-CoA synthase (HMGS) polypeptide; b) one or more heterologous nucleic acids comprising a nucleotide sequence encoding a truncated 3-hydroxy-3-methyl-glutaryl-CoA reductase (tHMGR) polypeptide; c) one or more heterologous nucleic acids comprising a nucleotide sequence encoding a mevalonate kinase (MK) polypeptide; d) one or more heterologous nucleic acids comprising a nucleotide sequence encoding a phosphomevalonate kinase (PMK) polypeptide; e) one or more heterologous nucleic acids comprising a nucleotide sequence encoding a mevalonate pyrophosphate decarboxylase (MVD1) polypeptide; or f) one or more heterologous nucleic acids comprising a nucleotide sequence encoding a isopentenyl diphosphate isomerase (IDI1) polypeptide.

Embodiment I-64. The modified host cell of Embodiment I-63, wherein the IDI1 polypeptide comprises an amino acid sequence having at least 85% sequence identity to SEQ ID NO:25.

Embodiment I-65. The modified host cell of Embodiment I-63 or I-64, wherein the tHMGR polypeptide comprises an amino acid sequence having at least 85% sequence identity to SEQ ID NO:27.

Embodiment I-66. The modified host cell of any one of Embodiments I-63 to I-65, wherein the HMGS polypeptide comprises an amino acid sequence having at least 85% sequence identity to SEQ ID NO:29.

Embodiment I-67. The modified host cell of any one of Embodiments I-63 to I-66, wherein the MK polypeptide comprises an amino acid sequence having at least 85% sequence identity to SEQ ID NO:39.

Embodiment I-68. The modified host cell of any one of Embodiments I-63 to I-67, wherein the PMK polypeptide comprises an amino acid sequence having at least 85% sequence identity to SEQ ID NO:37.

Embodiment I-69. The modified host cell of any one of Embodiments I-63 to I-68, wherein the MVD1 polypeptide comprises an amino acid sequence having at least 85% sequence identity to SEQ ID NO:33.

Embodiment I-70. The modified host cell of any one of Embodiments I-49 to I-69, wherein the modified host cell comprises one or more heterologous nucleic acids comprising a nucleotide sequence encoding an acetoacetyl-CoA thiolase polypeptide.

Embodiment I-71. The modified host cell of Embodiment I-70, wherein the acetoacetyl-CoA thiolase polypeptide comprises an amino acid sequence having at least 85% sequence identity to SEQ ID NO:31.

Embodiment I-72. The modified host cell of any one of Embodiments I-49 to I-71, wherein the modified host cell comprises one or more heterologous nucleic acids comprising a nucleotide sequence encoding a pyruvate decarboxylase (PDC) polypeptide.

Embodiment I-73. The modified host cell of Embodiment I-72, wherein the PDC polypeptide comprises an amino acid sequence having at least 85% sequence identity to SEQ ID NO:35.

Embodiment I-74. The modified host cell of any one of Embodiments I-49 to I-73, wherein the modified host cell comprises one or more heterologous nucleic acids comprising a nucleotide sequence encoding a geranyl pyrophosphate synthetase (GPPS) polypeptide.

Embodiment I-75. The modified host cell of Embodiment I-74, wherein the GPPS polypeptide comprises an amino acid sequence having at least 85% sequence identity to SEQ ID NO:41.

Embodiment I-76. The modified host cell of any one of Embodiments I-49 to I-75, wherein the modified host cell comprises one or more heterologous nucleic acids comprising a nucleotide sequence encoding a KAR2 polypeptide.

Embodiment I-77. The modified host cell of Embodiment I-76, wherein the KAR2 polypeptide comprises an amino acid sequence having at least 85% sequence identity to SEQ ID NO:5.

Embodiment I-78. The modified host cell of Embodiment I-76 or I-77, wherein the modified host cell comprises two or more heterologous nucleic acids comprising a nucleotide sequence encoding a KAR2 polypeptide.

Embodiment I-79. The modified host cell of any one of Embodiments I-49 to I-78, wherein the modified host cell comprises one or more heterologous nucleic acids comprising a nucleotide sequence encoding a PDI1 polypeptide.

Embodiment I-80. The modified host cell of Embodiment I-79, wherein the PDI1 polypeptide comprises an amino acid sequence having at least 85% sequence identity to SEQ ID NO:9.

Embodiment I-81. The modified host cell of any one of Embodiments I-49 to I-80, wherein the modified host cell comprises one or more heterologous nucleic acids comprising a nucleotide sequence encoding an IRE1 polypeptide.

Embodiment I-82. The modified host cell of Embodiment I-81, wherein the IRE1 polypeptide comprises an amino acid sequence having at least 85% sequence identity to SEQ ID NO:11 or SEQ ID NO:296.

Embodiment I-83. The modified host cell of any one of Embodiments I-49 to I-82, wherein the modified host cell comprises one or more heterologous nucleic acids comprising a nucleotide sequence encoding an ERO1 polypeptide.

Embodiment I-84. The modified host cell of Embodiment I-83, wherein the ERO1 polypeptide comprises an amino acid sequence having at least 85% sequence identity to SEQ ID NO:7.

Embodiment I-85. The modified host cell of any one of Embodiments I-49 to I-84, wherein the modified host cell comprises a deletion or downregulation of one or more genes encoding a PEP4 polypeptide.

Embodiment I-86. The modified host cell of Embodiment I-85, wherein the PEP4 polypeptide comprises an amino acid sequence having at least 85% sequence identity to SEQ ID NO:15.

Embodiment I-87. The modified host cell of any one of Embodiments I-49 to I-86, wherein the modified host cell comprises a deletion or downregulation of one or more genes encoding a ROT2 polypeptide.

Embodiment I-88. The modified host cell of Embodiment I-87, wherein the ROT2 polypeptide comprises an amino acid sequence having at least 85% sequence identity to SEQ ID NO:13.

Embodiment I-89. The modified host cell of any one of Embodiments I-49 to I-88, wherein the modified host cell is a eukaryotic cell.

Embodiment I-90. The modified host cell of Embodiment I-89, wherein the eukaryotic cell is a yeast cell.

Embodiment I-91. The modified host cell of Embodiment I-90, wherein the yeast cell is *Saccharomyces cerevisiae.*

Embodiment I-92. The modified host cell of Embodiment I-91, wherein the *Saccharomyces cerevisiae* is a protease-deficient strain of *Saccharomyces cerevisiae.*

Embodiment I-93. The modified host cell of any one of Embodiments I-49 to I-92, wherein at least one of the one or more nucleic acids are integrated into the chromosome of the modified host cell.

Embodiment I-94. The modified host cell of any one of Embodiments I-49 to I-92, wherein at least one of the one or more nucleic acids are maintained extrachromosomally.

Embodiment I-95. The modified host cell of any one of Embodiments I-49 to I-94, wherein at least one of the one or more nucleic acids are operably-linked to an inducible promoter.

Embodiment I-96. The modified host cell of any one of Embodiments I-49 to I-94, wherein at least one of the one or more nucleic acids are operably-linked to a constitutive promoter.

Embodiment I-97. The modified host cell of any one of Embodiments I-49 to I-96, wherein the modified host cell produces a cannabinoid or a cannabinoid derivative in an amount, as measured in mg/L or mM, greater than an amount of the cannabinoid or the cannabinoid derivative produced by a modified host cell comprising one or more nucleic acids comprising a nucleotide sequence encoding a cannabidiolic acid synthase polypeptide having an amino acid sequence of SEQ ID NO:3, wherein the modified host cell comprising one or more nucleic acids comprising the nucleotide sequence encoding the cannabidiolic acid synthase polypeptide having the amino acid sequence of SEQ ID NO:3 lacks a nucleic acid comprising a nucleotide sequence encoding an engineered variant of any one of Embodiments I-1 to I-42, grown under similar culture conditions for the same length of time.

Embodiment I-98. The modified host cell of any one of Embodiments I-49 to I-97, wherein the modified host cell produces a cannabinoid or a cannabinoid derivative in an amount, as measured in mg/L or mM, at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% greater than an amount of the cannabinoid or the cannabinoid derivative produced by a modified host cell comprising one or more nucleic acids comprising a nucleotide sequence encoding a cannabidiolic acid synthase polypeptide having an amino acid sequence of SEQ ID NO:3, wherein the modified host cell comprising one or more nucleic acids comprising the nucleotide sequence encoding the cannabidiolic acid synthase polypeptide having the amino acid sequence of SEQ ID NO:3 lacks a nucleic acid comprising a nucleotide sequence encoding an engineered variant of any one of Embodiments I-1 to I-42, grown under similar culture conditions for the same length of time.

Embodiment I-99. The modified host cell of any one of Embodiments I-49 to I-98, wherein the modified host cell has a faster growth rate and/or higher biomass yield compared to a growth rate and/or higher biomass yield of a modified host cell comprising one or more nucleic acids comprising a nucleotide sequence encoding a cannabidiolic acid synthase polypeptide having an amino acid sequence of SEQ ID NO:3, wherein the modified host cell comprising one or more nucleic acids comprising the nucleotide sequence encoding the cannabidiolic acid synthase polypeptide having the amino acid sequence of SEQ ID NO:3 lacks a nucleic acid comprising a nucleotide sequence encoding an engineered variant of any one of Embodiments I-1 to I-42, grown under similar culture conditions for the same length of time.

Embodiment I-100. The modified host cell of any one of Embodiments I-49 to I-99, wherein the modified host cell has a growth rate and/or higher biomass yield at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% faster than a growth rate and/or higher biomass yield of a modified host cell comprising one or more nucleic acids comprising a nucleotide sequence encoding a cannabidiolic acid synthase polypeptide having an amino acid sequence of SEQ ID NO:3, wherein the modified host cell comprising one or more nucleic acids comprising the nucleotide sequence encoding the cannabidiolic acid synthase polypeptide having the amino acid sequence of SEQ ID NO:3 lacks a nucleic acid comprising a nucleotide sequence encoding an engineered variant of any one of Embodiments I-1 to I-42, grown under similar culture conditions for the same length of time.

Embodiment I-101. The modified host cell of any one of Embodiments I-49 to I-100, wherein the modified host cell produces cannabidiolic acid (CBDA) from cannabigerolic acid (CBGA) in an increased ratio of CBDA over tetrahydrocannabinolic acid (THCA) compared to that produced by a modified host cell comprising one or more nucleic acids comprising a nucleotide sequence encoding a cannabidiolic acid synthase polypeptide having an amino acid sequence of SEQ ID NO:3, wherein the modified host cell comprising one or more nucleic acids comprising the nucleotide sequence encoding the cannabidiolic acid synthase polypeptide having the amino acid sequence of SEQ ID NO:3 lacks a nucleic acid comprising a nucleotide sequence encoding an engineered variant of any one of Embodiments I-1 to I-42, grown under similar culture conditions for the same length of time.

Embodiment I-102. The modified host cell of any one of Embodiments I-49 to I-101, wherein the modified host cell produces CBDA from CBGA in a ratio of CBDA over THCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

Embodiment I-103. A method of producing a cannabinoid or a cannabinoid derivative, the method comprising: a) culturing a modified host cell of any one of Embodiments I-49 to I-102 in a culture medium.

Embodiment I-104. The method of Embodiment I-103, wherein the method comprises: b) recovering the produced cannabinoid or cannabinoid derivative.

Embodiment I-105. The method of Embodiment I-103 or I-104, wherein the culture medium comprises a carboxylic acid.

Embodiment I-106. The method of Embodiment I-105, wherein the carboxylic acid is an unsubstituted or substituted $C_3$-$C_{18}$ carboxylic acid.

Embodiment I-107. The method of Embodiment I-106, wherein the unsubstituted or substituted $C_3$-$C_{18}$ carboxylic acid is an unsubstituted or substituted hexanoic acid.

Embodiment I-108. The method of Embodiment I-103 or I-104, wherein the culture medium comprises olivetolic acid or an olivetolic acid derivative.

Embodiment I-109. The method of Embodiment I-103 or I-104, wherein the cannabinoid is cannabidiolic acid, cannabidiol, cannabidivarinic acid, or cannabidivarin.

Embodiment I-110. The method of any one of Embodiments I-103 to I-109, wherein the culture medium comprises a fermentable sugar.

Embodiment I-111. The method of any one of Embodiments I-103 to I-109, wherein the culture medium comprises a pretreated cellulosic feedstock.

Embodiment I-112. The method of any one of Embodiments I-103 to I-109, wherein the culture medium comprises a non-fermentable carbon source.

Embodiment I-113. The method of Embodiment I-112, wherein the non-fermentable carbon source comprises ethanol.

Embodiment I-114. The method of any one of Embodiments I-103 to I-113, wherein the cannabinoid or the cannabinoid derivative is produced in an amount of more than 100 mg/L culture medium.

Embodiment I-115. The method of any one of Embodiments I-103 to I-113, wherein the cannabinoid or the cannabinoid derivative is produced in an amount, as measured in mg/L or mM, greater than an amount of the cannabinoid or the cannabinoid derivative produced in a method comprising culturing a modified host cell comprising one or more nucleic acids comprising a nucleotide sequence encoding a cannabidiolic acid synthase polypeptide having an amino acid sequence of SEQ ID NO:3 instead of the modified host cell of any one of Embodiments I-49 to I-102, wherein the modified host cell comprising one or more nucleic acids comprising the nucleotide sequence encoding the cannabidiolic acid synthase polypeptide having the amino acid sequence of SEQ ID NO:3 lacks a nucleic acid comprising a nucleotide sequence encoding an engineered variant of any one of Embodiments I-1 to I-42, and wherein the modified host cell of any one of Embodiments I-49 to I-102 and the modified host cell comprising one or more nucleic acids comprising the nucleotide sequence encoding the cannabidiolic acid synthase polypeptide having the amino acid sequence of SEQ ID NO:3, but lacking a nucleic acid comprising a nucleotide sequence encoding an engineered variant of any one of Embodiments I-1 to I-42, are cultured under similar culture conditions for the same length of time.

Embodiment I-116. The method of any one of Embodiments I-103 to I-115, wherein the cannabinoid or the cannabinoid derivative is produced in an amount, as measured in mg/L or mM, at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% greater than an amount of the cannabinoid or the cannabinoid derivative produced in a method comprising culturing a modified host cell comprising one or more nucleic acids comprising a nucleotide sequence encoding a cannabidiolic acid synthase polypeptide having an amino acid sequence of SEQ ID NO:3 instead of the modified host cell of any one of Embodiments I-49 to I-102, wherein the modified host cell comprising one or more nucleic acids comprising the nucleotide sequence encoding the cannabidiolic acid synthase polypeptide having the amino acid sequence of SEQ ID NO:3 lacks a nucleic acid comprising a nucleotide sequence encoding an engineered variant of any one of Embodiments I-1 to I-42, and wherein the modified host cell of any one of Embodiments I-49 to I-102 and the modified host cell comprising one or more nucleic acids comprising the nucleotide sequence encoding the cannabidiolic acid synthase polypeptide having the amino acid sequence of SEQ ID NO:3, but lacking a nucleic acid comprising a nucleotide sequence encoding an engineered variant of any one of Embodiments I-1 to I-42, are cultured under similar culture conditions for the same length of time.

Embodiment I-117. The method of any one of Embodiments I-103 to I-116, wherein the cannabinoid is cannabidiolic acid (CBDA), and wherein the method produces CBDA in an increased ratio of CBDA over tetrahydrocannabinolic acid (THCA) compared to that produced in a method comprising culturing a modified host cell comprising one or more nucleic acids comprising a nucleotide sequence encoding a cannabidiolic acid synthase polypeptide having an amino acid sequence of SEQ ID NO:3 instead of the modified host cell of any one of Embodiments I-49 to I-102, wherein the modified host cell comprising one or more nucleic acids comprising the nucleotide sequence encoding the cannabidiolic acid synthase polypeptide having the amino acid sequence of SEQ ID NO:3 lacks a nucleic acid comprising a nucleotide sequence encoding an engineered variant of any one of Embodiments I-1 to I-42, grown under similar culture conditions for the same length of time.

Embodiment I-118. The method of any one of Embodiments I-103 to I-117, wherein the method produces CBDA from CBGA in a ratio of CBDA over THCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

Embodiment I-119. A method of producing a cannabinoid or a cannabinoid derivative, the method comprising use of an engineered variant of any one of Embodiments I-1 to I-42.

Embodiment I-120. The method of Embodiment I-119, wherein the method comprises recovering the produced cannabinoid or cannabinoid derivative.

Embodiment I-121. The method of Embodiment I-119 or I-120, wherein the cannabinoid is cannabidiolic acid, cannabidiol, cannabidivarinic acid, or cannabidivarin.

Embodiment I-122. The method of any one of Embodiments I-119 to I-121, wherein the cannabinoid or the cannabinoid derivative is produced in an amount, as measured in mg/L or mM, greater than an amount of the cannabinoid or the cannabinoid derivative produced in a method comprising use of a cannabidiolic acid synthase polypeptide having an amino acid sequence of SEQ ID NO:3 instead of the engineered variant of any one of Embodiments I-1 to I-42, wherein the engineered variant of any one of Embodiments I-1 to I-42 and the cannabidiolic acid synthase polypeptide having the amino acid sequence of SEQ ID NO:3 are used under similar conditions for the same length of time.

Embodiment I-123. The method of any one of Embodiments I-119 to I-121, wherein the cannabinoid or the cannabinoid derivative is produced in an amount, as measured in mg/L or mM, at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% greater than an amount of the cannabinoid or the cannabinoid derivative produced in a method comprising use of a cannabidiolic acid synthase polypeptide having an amino acid sequence of SEQ ID NO:3 instead of the engineered variant of any one of Embodiments I-1 to I-42, wherein the engineered variant of any one of Embodiments I-1 to I-42 and the cannabidiolic acid synthase polypeptide having the amino acid sequence of SEQ ID NO:3 are used under similar conditions for the same length of time.

Embodiment I-124. The method of any one of Embodiments I-119 to I-123, wherein the cannabinoid is cannabidiolic acid (CBDA), and wherein the method produces CBDA in an increased ratio of CBDA over tetrahydrocannabinolic acid (THCA) compared to that produced in a method comprising use of a cannabidiolic acid synthase polypeptide having an amino acid sequence of SEQ ID NO:3 instead of the engineered variant of any one of Embodiments I-1 to I-42, wherein the engineered variant of any one of Embodiments I-1 to I-42 and the cannabidiolic acid synthase polypeptide having the amino acid sequence of SEQ ID NO:3 are used under similar conditions for the same length of time.

Embodiment I-125. The method of any one of Embodiments I-119 to I-124, wherein the method produces CBDA from CBGA in a ratio of CBDA over THCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

Embodiment I-126. A method of screening an engineered variant of a cannabidiolic acid synthase (CBDAS) polypeptide comprising an amino acid sequence of SEQ ID NO:3 with one or more amino acid substitutions, the method comprising: a) dividing a population of host cells into a control population and a test population; b) co-expressing in the control population a CBDAS polypeptide having an amino acid sequence of SEQ ID NO:3 and a comparison cannabinoid synthase polypeptide, wherein the CBDAS polypeptide having an amino acid sequence of SEQ ID NO:3 can convert cannabigerolic acid (CBGA) to a first cannabinoid, cannabidiolic acid (CBDA), and the comparison cannabinoid synthase polypeptide can convert the same CBGA to a different second cannabinoid; c) co-expressing in the test population the engineered variant and the comparison cannabinoid synthase polypeptide, wherein the engineered variant may convert CBGA to the same first cannabinoid, cannabidiolic acid (CBDA), as the CBDAS polypeptide having an amino acid sequence of SEQ ID NO:3, and wherein the comparison cannabinoid synthase polypeptide can convert the same CBGA to the second cannabinoid and is expressed at similar levels in the test population and in the control population; d) measuring a ratio of the first cannabinoid, cannabidiolic acid (CBDA), over the second cannabinoid produced by both the test population and the control population; and e) measuring an amount, in mg/L or mM, of the first cannabinoid produced by both the test population and the control population.

Embodiment I-127. The method of Embodiment I-126, wherein the test population is identified as comprising an engineered variant having improved in vivo performance compared to the cannabidiolic acid synthase polypeptide having an amino acid sequence of SEQ ID NO:3, wherein improved in vivo performance is demonstrated by an increase in the ratio of the first cannabinoid over the second cannabinoid produced by the test population compared to that produced by the control population under similar culture conditions for the same length of time.

Embodiment I-128. The method of Embodiment I-126 or I-127, wherein the test population is identified as comprising an engineered variant having improved in vivo performance compared to the cannabidiolic acid synthase polypeptide having an amino acid sequence of SEQ ID NO:3 by producing the first cannabinoid in a greater amount, as measured in mg/L or mM, by the test population compared to the amount produced by the control population under similar culture conditions for the same length of time.

Embodiment I-129. The method of any one of Embodiments I-126 to I-128, wherein the cannabinoid synthase polypeptide is a tetrahydrocannabinolic acid synthase polypeptide.

Embodiment I-130. The method of Embodiment I-129, wherein the tetrahydrocannabinolic acid synthase polypeptide comprises an amino acid sequence having at least 85% sequence identity to SEQ ID NO:44.

Embodiment I-131. The method of any one of Embodiments I-126 to I-130, wherein the second cannabinoid is tetrahydrocannabinolic acid (THCA).

Embodiment I-132. The method of any one of Embodiments I-126 to I-131, wherein the engineered variant is an engineered variant of any one of Embodiments I-1 to I-42.

Provided in Table 1 are amino acid and nucleotide sequences disclosed herein. Where a genus and/or species is noted, the sequence should not be construed to be limited only to the specified genus and/or species, but also includes other genera and/or species expressing said sequence. Orthologs of the sequences disclosed in Table 1 may also be encompassed by this disclosure. Nucleotide sequences indicated as codon optimized in Table 1 are codon optimized for expression in *S. cerevisiae*. In Table 1, "*" used as the end of a sequence denotes a stop codon. In reference to OAC*, "*" denotes a mutation is present in the sequence.

TABLE 1

| Amino acid and nucleotide sequences of the disclosure | |
|---|---|
| SEQ ID NO: 1<br>Cannabidiolic<br>Acid<br>(CBDA) Synthase<br>Codon opt 2<br>Artificial<br>sequence<br>Codon optimized | ATGAAATGCTCTACCTTTTCTTTCTGGTTCGTTTGTAAGATTATC<br>TTCTTCTTCTTCTCCTTCAACATCCAAACCTCTATCGCTAACCCT<br>CGTGAAAACTTTTTGAAATGTTTTTCCCAATACATCCCAAATAAC<br>GCTACTAATTTGAAGTTGGTTTACACCCAAAACAACCCATTGTAT<br>ATGTCCGTTTTAAACTCTACTATTCACAATTTGCGTTTTACCTCT<br>GATACTACCCCTAAACCATTGGTCATTGTTACCCCATCCCATGTT<br>TCTCATATCCAAGGTACTATCTTGTGTTCTAAAAAGGTTGGTTTG<br>CAAATTAGAACTCGTTCCGGTGGTCACGATTCTGAAGGTATGTCT<br>TACATTTCTCAAGTTCCTTTCGTCATTGTCGACTTGAGAAACATG<br>AGATCCATCAAAATTGATGTTCACTCTCAAACTGCTTGGGTCGAA<br>GCCGGTGCCACTTTAGGTGAGGTCTACTATTGGGTTAACGAGAAG<br>AACGAAAACTTGTCTTTGGCTGCCGGTTACTGTCCAACTGTCTGT<br>GCTGGTGGTCATTTTGGTGGTGGTGGTTACGGTCCATTGATGAGA<br>AACTACGGTTTGGCTGCTGATAACATTATTGATGCTCACTTAGTT<br>AACGTCCACGGTAAAGTCTTGGATAGAAAGTCCATGGGTGAAGAC<br>TTGTTCTGGGCTTTAAGAGGTGGTGGTGCTGAATCCTTCGGTATT<br>ATTGTTGCTTGGAAAATCAGATTGGTCGCTGTTCCAAAATCCACC<br>ATGTTTTCTGTCAAGAAAATCATGGAAATTCATGAATTAGTTAAG<br>TTGGTCAACAAATGGCAAAACATTGCCTATAAATACGACAAGGAT<br>TTGTTGTTGATGACTCATTTCATCACTCGTAACATCACTGATAAT<br>CAAGGTAAGAACAAGACTGCTATCCATACTTACTTCTCTTCCGTC<br>TTCTTGGGTGGTGTTGACTCTTTGGTCGATTTGATGAACAAATCC<br>TTTCCAGAGTTAGGTATTAAGAAGACTGACTGTAGACAATTATCT<br>TGGATTGACACTATTATCTTCTACTCTGGTGTTGTCAATTACGAT<br>ACTGATAACTTTAACAAGGAAATTTTGTTGGACCGTTCTGCTGGT<br>CAAAACGGTGCCTTCAAGATTAAGTTAGATTACGTTAAGAAGCCA<br>ATCCCAGAATCTGTCTTCGTCCAAATTTTGGAGAAATTGTATGAA<br>GAGGACATTGGTGCTGGTATGTACGCCTTGTATCCTTACGGTGGT<br>ATCATGGACGAGATCTCCGAATCTGCCATCCCTTTTCCTCATCGT<br>GCTGGTATCTTGTACGAGTTGTGGTACATCTGTTCCTGGGAGAAG<br>CAAGAAGATAATGAAAAGCACTTGAACTGGATTAGAAATATTTAT<br>AATTTCATGACTCCATACGTTTCTAAGAACCCACGTTTGGCTTAC<br>TTAAATTACAGAGATTTGGATATTGGTATCAACGACCCTAAGAAC<br>CCTAACAACTACACTCAAGCTAGAATTTGGGGTGAGAAATATTTC<br>GGTAAGAACTTCGATAGATTGGTCAAGGTTAAAACTTTAGTTGAT<br>CCAAATAACTTTTTTAGAAACGAACAATCTATTCCACCATTGCCA<br>AGACACAGACACTAG |
| SEQ ID NO: 2<br>Cannabidiolic<br>Acid<br>(CBDA) Synthase<br>Codon opt 5<br>Artificial<br>sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG |

TABLE 1-continued

| Amino acid and nucleotide sequences of the disclosure | |
|---|---|
| | CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 3<br>Cannabidiolic<br>Acid<br>(CBDA)<br>Synthase<br>Polypeptide<br>front codon<br>opts 2 and 5<br>*Cannabis sativa* | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKIKLDYVKKPIPESVFVQILEKLYEE<br>DIGAGMYALYPYGGIMDEISESAIPPPHRAGILYELWYICSWEKQ<br>EDNEKHLNWIRNIYNFMTPYVSKNPRLAYLNYRDLDIGINDPKNP<br>NNYTQARIWGEKYFGKNFDRLVKVKTLVDPNNFFRNEQSIPPLPR<br>HRH* |
| SEQ ID NO: 4<br>KAR2<br>*Saccharomyces* sp. | ATGTTTTTCAACAGACTAAGCGCTGGCAAGCTGCTGGTACCACTC<br>TCCGTGGTCCTGTACGCCCTTTTCGTGGTAATATTACCTTTACAG<br>AATTCTTTCCACTCCTCCAATGTTTTAGTTAGAGGTGCCGATGAT<br>GTAGAAAACTACGGAACTGTTATCGGTATTGACTTAGGTACTACT<br>TATTCCTGTGTTGCTGTGATGAAAAATGGTAAGACTGAAATTCTT<br>GCTAATGAGCAAGGTAACAGAATCACCCCATCTTACGTGGCATTC<br>ACCGATGATGAAAGATTGATTGGTGATGCTGCAAAGAACCAAGTT<br>GCTGCCAATCCTCAAAACACCATCTTCGACATTAAGAGATTGATC<br>GGTTTGAAATATAACGACAGATCTGTTCAGAAGGATATCAAGCAC<br>TTGCCATTTAATGTGGTTAATAAAGATGGGAAGCCCGCTGTAGAA<br>GTAAGTGTCAAAGGAGAAAAGAAGGTTTTTACTCCAGAAGAAATT<br>TCTGGTATGATCTTGGGTAAGATGAAACAAATTGCCGAAGATTAT<br>TTAGGCACTAAGGTTACCCATGCTGTCGTTACTGTTCCTGCTTAT<br>TTCAATGACGCGCAAAGACAAGCCACCAAGGATGCTGGTACCATC<br>GCTGGTTTGAACGTTTTGAGAATTGTTAATGAACCAACCGCAGCC<br>GCCATTGCCTACGGTTTGGATAAATCTGATAAGGAACATCAAATT<br>ATTGTTTATGATTTGGGTGGTGGTACTTTCGATGTCTCTCTATTG<br>TCTATTGAAAACGGTGTTTTCGAAGTCCAAGCCACTTCTGGTGAT<br>ACTCATTTAGGTGGTGAAGATTTTGACTATAAGATCGTTCGTCAA<br>TTGATAAAAGCTTTCAAGAAGAAGCATGGTATTGATGTGTCTGAC<br>AACAACAAGGCCCTAGCTAAATTGAAGAGAGAAGCTGAAAAGGCT<br>AAACGTGCCTTGTCCAGCCAAATGTCCACCCGTATTGAAATTGAC<br>TCCTTCGTTGATGGTATCGACTTAAGTGAAACCTTGACCAGAGCT<br>AAGTTTGAGGAATTAAACCTAGATCTATTCAAGAAGACCTTGAAG<br>CCTGTCGAGAAGGTTTTGCAAGATTCTGGTTTGGAAAAGAAGGAT<br>GTTGATGATATCGTTTTGGTTGGTGGTTCTACTAGAATTCCAAAG<br>GTCCAACAATTGTTAGAATCATACTTTGATGGTAAGAAGGCCTCC<br>AAGGGTATTAACCCAGATGAAGCTGTTGCATACGGTGCAGCCGTT<br>CAAGCTGGTGTCTTATCCGGTGAAGAAGGTGTCGAAGATATTGTT<br>TTATTGGATGTCAACGCTTTGACTCTTGGTATTGAAACCACTGGT<br>GGTGTCATGACTCCATTAATTAAGAGAAATACTGCTATTCCTACA<br>AAGAAATCCCAAATTTTCTCTACTGCCGTTGACAACCAACCAACC<br>GTTATGATCAAGGTATACGAGGGTGAAAGAGCCATGTCTAAGGAC<br>AACAATCTATTAGGTAAGTTTGAATTAACCGGCATTCCACCAGCA<br>CCAAGAGGTGTACCTCAAATTGAAGTCACATTTGCACTTGACGCT<br>AATGGTATTCTGAAGGTGTCTGCCACAGATAAGGGAACTGGTAAA<br>TCCGAATCTATCACCATCACTAACGATAAAGGTAGATTAACCCAA<br>GAAGAGATTGATAGAATGGTTGAAGAGGCTGAAAAATTCGCTTCT<br>GAAGACGCTTCTATCAAGGCCAAGGTTGAATCTAGAAACAAATTA<br>GAAAACTACGCTCACTCTTTGAAAAACCAAGTTAATGGTGACCTA<br>GGTGAAAAATTGGAAGAAGAAGACAAGGAAACCTTATTAGATGCT<br>GCTAACGATGTTTTAGAATGGTTAGATGATAACTTTGAAACCGCC<br>ATTGCTGAAGACTTTGATGAAAAGTTCGAATCTTTGTCCAAGGTC<br>GCTTATCCAATTACTTCTAAGTTGTACGGAGGTGCTGATGGTTCT<br>GGTGCCGCTGATTATGACGACGAAGATGAAGATGACGATGGTGAT<br>TATTTCGA<br>ACACGACGAATTGTAG |
| SEQ ID NO: 5<br>KAR2<br>*Saccharomyces* sp. | MFFNRLSAGKLLVPLSWLYALFWILPLQNSFHSSNVLVRGADDVE<br>NYGTVIGIDLGTTYSCVAVMKNGKTEILANEQGNRITPSYVAFTD<br>DERLIGDAAKNQVAANPQNTIFDIKRLIGLKYNDRSVQKDIKHLP<br>FNWNKDGKPAVEVSVKGEKKVFTPEEISGMILGKMKQIAEDYLGT<br>KVTHAVVTVPAYFNDAQRQATKDAGTIAGLNVLRIVNEPTAAAIA<br>YGLDKSDKEHQIIVYDLGGGTFDVSLLSIENGVFEVQATSGDTHL<br>GGEDFDYKIVRQLIKAFKKKHGIDVSDNNKALAKLKREAEKAKRA<br>LSSQMSTRIEIDSFVDGIDLSETLTRAKFEELNLDLFKKTLKPVE |

TABLE 1-continued

| Amino acid and nucleotide sequences of the disclosure | |
|---|---|
| | KVLQDSGLEKKDVDDIVLVGGSTRIPKVQQLLESYFDGKKASKGI<br>NPDEAVAYGAAVQAGVLSGEEGVEDIVLLDVNALTLGIETTGGVM<br>TPLIKRNTA1PTKKSQIFSTAVDNQPTVMIKVYEGERAMSKDNNL<br>LGKFELTGIPPAPRGVPQIEVTFALDANGILKVSATDKGTGKSES<br>ITITNDKGRLTQEEIDRMVEEAEKFASEDASIKAKVESRNKLENY<br>AHSLKNQVNGDLGEKLEEEDKETLLDAANDVLEWLDDNFETAIAE<br>DFDEKFESLSKVAYPITSKLYGGADGSGAADYDDEDEDDDGDYFE<br>HDEL* |
| SEQ ID NO: 6<br>ERO1<br>*Saccharomyces* sp. | ATGAGATTAAGAACCGCCATTGCCACACTGTGCCTCACGGCTTTT<br>ACATCTGCAACTTCAAACAATAGCTACATCGCCACCGACCAAACA<br>CAAAATGCCTTTAATGACACTCACTTTTGTAAGGTCGACAGGAAT<br>GATCACGTTAGTCCCAGTTGTAACGTAACATTCAATGAATTAAAT<br>GCCATAAATGAAAACATTAGAGATGATCTTTCGGCGTTATTAAAA<br>TCTGATTTCTTCAAATACTTTCGGCTGGATTTATACAAGCAATGT<br>TCATTTTGGGACGCCAACGATGGTCTGTGCTTAAACCGCGCTTGC<br>TCTGTTGATGTCGTAGAGGACTGGGATACACTGCCTGAGTACTGG<br>CAGCCTGAGATCTTGGGTAGTTTCAATAATGATACAATGAAGGAA<br>GCGGATGATAGCGATGACGAATGTAAGTTCTTAGATCAACTATGT<br>CAAACCAGTAAAAAACCTGTAGATATCGAAGACACCATCAACTAC<br>TGTGATGTAAATGACTTTAACGGTAAAAACGCCGTTCTGATTGAT<br>TTAACAGCAAATCCGGAACGATTTACAGGTTATGGTGGTAAGCAA<br>GCTGGTCAAATTTGGTCTACTATCTACCAAGACAACTGTTTTACA<br>ATTGGCGAAACTGGTGAATCATTGGCCAAAGATGCATTTTATAGA<br>CTTGTATCCGGTTTCCATGCCTCTATCGGTACTCACTTATCAAAG<br>GAATATTTGAACACGAAAACTGGTAAATGGGAGCCCAATCTGGAT<br>TTGTTTATGGCAAGAATCGGGAACTTTCCTGATAGAGTGACAAAC<br>ATGTATTTCAATTATGCTGTTGTAGCTAAGGCTCTCTGGAAAATT<br>CAACCATATTTACCAGAATTTTCATTCTGTGATCTAGTCAATAAA<br>GAAATCAAAAACAAAATGGATAACGTTATTTCCCAGCTGGACACA<br>AAAATTTTTAACGAAGACTTAGTTTTTGCCAACGACCTAAGTTTG<br>ACTTTGAAGGACGAATTCAGATCTCGCTTCAAGAATGTCACGAAG<br>ATTATGGATTGTGTGCAATGTGATAGATGTAGATTGTGGGGCAAA<br>ATTCAAACTACCGGTTACGCAACTGCCTTGAAAATTTTGTTTGAA<br>ATCAACGACGCTGATGAATTCACCAAACAACATATTGTTGGTAAG<br>TTAACCAAATATGAGTTGATTGCACTATTACAAACTTTCGGTAGA<br>TTATCTGAATCTATTGAATCTGTTAACATGTTCGAAAAAATGTAC<br>GGGAAAAGGTTAAACGGTTCTGAAAACAGGTTAAGCTCATTCTTC<br>CAAAATAACTTCTTCAACATTTTGAAGGAGGCAGGCAAGTCGATT<br>CGTTACACCATAGAGAACATCAATTCCACTAAAGAAGGAAAGAAA<br>AAGACTAACAATTCTCAATCACATGTATTTGATGATTTAAAAATG<br>CCCAAAGCAGAAATAGTTCCAAGGCCCTCTAACGGTACAGTAAAT<br>AAATGGAAGAAAGCTTGGAATACTGAAGTTAACAACGTTTTAGAA<br>GCATTCAGATTTATTTATAGAAGCTATTTGGATTTACCCAGGAAC<br>ATCTGGGAATTATCTTTGATGAAGGTATACAAATTTTGGAATAAA<br>TTCATCGGTGTTGCTGATTACGTTAGTGAGGAGACACGAGAGCCT<br>ATTTCCTATAAGCTAGATATACAATAA |
| SEQ ID NO: 7<br>ERO1<br>*Saccharomyces* sp. | MRLRTAIATLCLTAFTSATSNNSYIATDQTQNAFNDTHFCKVDRN<br>DHVSPSCNVTFNELNAINENIRDDLSALLKSDFFKYFRLDLYKQC<br>SFWDANDGLCLNRACSVDVVEDWDTLPEYWQPEILGSFNNDTMKE<br>ADDSDDECKFLDQLCQTSKKPVDIEDTINYCDVNDFNGKNAVLID<br>LTANPERFTGYGGKQAGQIWSTIYQDNCFTIGETGESLAKDAFYR<br>LVSGFHASIGTHLSKEYLNTKTGKWEPNLDLFMARIGNFPDRVTN<br>MYFNYAWAKALWKIQPYLPEFSFCDLVNKEIKNKMDNVISQLDTK<br>IFNEDLVFANDLSLTLKDEFRSRFKNVTKIMDCVQCDRCRLWGKI<br>QTTGYATALKILFEINDADEFTKQHIVGKLTKYELIALLQTFGRL<br>SESIESVNMFEKMYGKRLNGSENRLSSFFQNNFFNILKEAGKSIR<br>YTIENINSTKEGKKKTNNSQSHVFDDLKMPKAEIVPRPSNGTVNK<br>WKKAWNTEVNNVLEAFRFIYRSYLDLPRNIWELSLMKVYKFWNKF<br>IGVADYVSEETREPISYKLDIQ* |
| SEQ ID NO: 8<br>PDI1<br>*Saccharomyces* sp. | ATGAAGTTTTCTGCTGGTGCCGTCCTGTCATGGTCCTCCCTGCTG<br>CTCGCCTCCTCTGTTTTCGCCCAACAAGAGGCTGTGGCCCCTGAA<br>GACTCCGCTGTCGTTAAGTTGGCCACCGACTCCTTCAATGAGTAC<br>ATTCAGTCGCACGACTTGGTGCTTGCGGAGTTTTTTGCTCCATGG<br>TGTGGCCACTGTAAGAACATGGCTCCTGAATACGTTAAAGCCGCC<br>GAGACTTTAGTTGAGAAAAACATTACCTTGGCCCAGATCGACTGT<br>ACTGAAAACCAGGATCTGTGTATGGAACACAACATTCCAGGGTTC<br>CCAAGCTTGAAGATTTTCAAAAACAGCGATGTTAACAACTCGATC<br>GATTACGAGGGACCTAGAACTGCCGAGGCCATTGTCCAATTCATG<br>ATCAAGCAAAGCCAACCGGCTGTCGCCGTTGTTGCTGATCTACCA<br>GCTTACCTTGCTAACGAGACTTTTGTCACTCCAGTTATCGTCCAA<br>TCCGGTAAGATTGACGCCGACTTCAACGCCACCTTTTACTCCATG<br>GCCAACAAACACTTCAACGACTACGACTTTGTCTCCGCTGAAAAC<br>GCAGACGATGATTTCAAGCTTTCTATTTACTTGCCCTCCGCCATG<br>GACGAGCCTGTAGTATACAACGGTAAGAAAGCCGATATCGCTGAC<br>GCTGATGTTTTTGAAAAATGGTTGCAAGTGGAAGCCTTGCCCTAC |

TABLE 1-continued

| Amino acid and nucleotide sequences of the disclosure | |
|---|---|
| | TTTGGTGAAATCGACGGTTCCGTTTTCGCCCAATACGTCGAAAGC<br>GGTTTGCCTTTGGGTTACTTATTCTACAATGACGAGGAAGAATTG<br>GAAGAATACAAGCCTCTCTTTACCGAGTTGGCCAAAAAGAACAGA<br>GGTCTAATGAACTTTGTTAGCATCGATGCCAGAAAATTCGGCAGA<br>CACGCCGGCAACTTGAACATGAAGGAACAATTCCCTCTATTTGCC<br>ATCCACGACATGACTGAAGACTTGAAGTACGGTTTGCCTCAACTC<br>TCTGAAGAGGCGTTTGACGAATTGAGCGACAAGATCGTGTTGGAG<br>TCTAAGGCTATTGAATCTTTGGTTAAGGACTTCTTGAAAGGTGAT<br>GCCTCCCCAATCGTGAAGTCCCAAGAGATCTTCGAGAACCAAGAT<br>TCCTCTGTCTTCCAATTGGTCGGTAAGAACCATGACGAAATCGTC<br>AACGACCCAAAGAAGGACGTTCTTGTTTTGTACTATGCCCCATGG<br>TGTGGTCACTGTAAGAGATTGGCCCCAACTTACCAAGAACTAGCT<br>GATACCTACGCCAACGCCACATCCGACGTTTTGATTGCTAAACTA<br>GACCACACTGAAAACGATGTCAGAGGCGTCGTAATTGAAGGTTAC<br>CCAACAATCGTCTTATACCCAGGTGGTAAGAAGTCCGAATCTGTT<br>GTGTACCAAGGTTCAAGATCCTTGGACTCTTTATTCGACTTCATC<br>AAGGAAAACGGTCACTTCGACGTCGACGGTAAGGCCTTGTACGAA<br>GAAGCCCAGGAAAAAGCTGCTGAGGAAGCCGATGCTGACGCTGAA<br>TTGGCTGACGAAGAAGATGCCATTCACGATGAATTGTAA |
| SEQ ID NO: 9<br>PDI1<br>*Saccharomyces* sp. | MKFSAGAVLSWSSLLLASSVFAQQEAVAPEDSAVVKLATDSFNEY<br>IQSHDLVLAEFFAPWCGHCKNMAPEYVKAAETLVEKNITLAQIDC<br>TENQDLCMEHNIPGFPSLKIFKNSDVNNSIDYEGPRTAEAIVQFM<br>IKQSQPAVAVVADLPAYLANETFVTPVIVQSGKIDADFNATFYSM<br>ANKHFNDYDFVSAENADDDFKLSIYLPSAMDEPWYNGKKADIADA<br>DVFEKWLQVEALPYFGEIDGSVFAQYVESGLPLGYLFYNDEEELE<br>EYKPLFTELAKKNRGLMNFVSIDARKFGRHAGNLNMKEQFPLFAI<br>HDMTEDLKYGLPQLSEEAFDELSDKIVLESKAIESLVKDFLKGDA<br>SPIVKSQEIFENQDSSVFQLVGKNHDEIVNDPKKDVLVLYYAPWC<br>GHCKRLAPTYQELADTYANATSDVLIAKLDHTENDVRGWIEGYPT<br>IVLYPGGKKSESWYQGSRSLDSLFDFIKENGHFDVDGKALYEEAQ<br>EKAAEEADADAELADEEDAIHDEL* |
| SEQ ID NO: 10<br>IRE1<br>*Saccharomyces* sp. | ATGCGTCTACTTCGAAGAAACATGTTAGTATTGACACTGCTCGTT<br>TGTGTGTTTTCATCCATCATTTCATGCTCAATCCCATTGTCGTCT<br>CGCACCTCAAGGCGGCAGATAGTGGAAGATGAAGTTGCCTCCACT<br>AAAAAGCTCAATTTCAACTATGGTGTGGATAAAAATATAAACTCG<br>CCCATTCCTGCTCCAAGAACCACTGAAGGTTTACCAAATATGAAA<br>CTCAGCTCATATCCAACTCCTAACTTATTGAATACTGCTGATAAT<br>CGACGTGCTAACAAAAAAGGACGTAGGGCTGCCAATTCTATAAGT<br>GTACCCTATTTGGAGAATCGTTCCTTGAACGAACTGAGTTTATCA<br>GATATACTAATCGCAGCCGACGTTGAGGGTGGACTTCATGCTGTA<br>GATAGAAGAAATGGTCATATCATATGGTCAATCGAACCAGAAAAT<br>TTTCAACCTCTGATAGAAATACAAGAACCTTCGAGGTTAGAAACA<br>TATGAAACGTTGATTATAGAACCTTTCGGTGATGGGAACATTTAC<br>TACTTTAACGCCCATCAAGGGTTACAAAAACTGCCTTTATCCATA<br>CGACAACTTGTATCAACTTCCCCGCTGCACTTGAAAACAAATATT<br>GTGGTTAATGACTCTGGAAAAATTGTTGAAGATGAAAAGGTCTAC<br>ACTGGATCGATGAGAACTATAATGTATACTATAAACATGTTGAAT<br>GGTGAAATTATATCAGCGTTCGGACCTGGTTCAAAAAACGGGTAT<br>TTCGGGAGCCAGAGTGTGGATTGCTCACCTGAGGAGAAGATAAAA<br>CTTCAGGAATGTGAAAATATGATTGTAATAGGCAAAACTATTTTT<br>GAGCTGGGAATTCACTCTTATGATGGAGCAAGCTACAATGTCACT<br>TACTCTACATGGCAGCAAAATGTTTTAGATGTTCCCCTAGCGCTT<br>CAGAATACATTTTCAAAGGACGGCATGTGCATAGCGCCTTTCCGT<br>GATAAATCATTGCTAGCAAGCGATTTAGATTTTAGAATTGCTAGA<br>TGGGTTTCTCCGACATTCCCCGGAATTATTGTTGGGCTTTTCGAT<br>GTGTTTAATGATCTCCGCACCAATGAAAATATACTGGTACCGCAT<br>CCCTTTAATCCTGGTGATCATGAAAGTATATCGAGTAACAAAGTT<br>TACTTGGATCAGACTTCGAACCTCTCCTGGTTTGCATTATCTAGT<br>CAGAATTTTCCATCTTTAGTCGAATCAGCTCCCATATCAAGATAC<br>GCTTCCAGTGACCGTTGGAGGGTGTCTTCAATTTTTGAAGATGAG<br>ACTTTATTCAAGAACGCAATCATGGGTGTTCATCAGATATATAAT<br>AATGAATATGATCACCTTTATGAAAACTATGAAAAAACGAATAGT<br>TTGGACACTACGCACAAATATCCACCTCTGATGATTGATTCGTCC<br>GTTGATACAACCGATTTACATCAGAATAACGAGATGAATTCACTA<br>AAGGAATACATGTCACCAGAAGACCTTGAGGCATATAGAAAAAAG<br>ATACACGAGCAAATATCGAGAGAATTAGATGAAAAGAACCAAAAT<br>TCTTTGCTACTGAAGTTTGGAAGTCTAGTATATCGAATTATAGAG<br>ACTGGAGTTTGCCGCCACTATATGTATTATTATCCAAAATTGGAT<br>TTATGCCTGAAAAGGAAATCCCCATAGTTGAGTCGAAATCGCTAA<br>ATTGTCCCTCTTCATCGGAAAATGTAACCAAGCCATTCGATATGA<br>AATCAGGGAAGCAAGTTGTTTTTGAAGGTGCTGTGAACGATGGAA<br>GTCTAAAATCTGAAAAAGATAACGATGATGCTGATGAAGATGATG<br>AAAAATCACTAGATTTAACCACAGAAAAGAAGAAGAGGAAAAGAG<br>GTTCGAGAGGAGGCAAAAAGGGCCGAAAATCACGCATTGCAAATA<br>TACCAAACTTTGAGCAATCTTTAAAAAATTTGGTAGTATCCGAAA<br>AAATTTTAGGTTACGGTTCATCAGGAACAGTAGTTTTTCAGGGAA |

TABLE 1-continued

| Amino acid and nucleotide sequences of the disclosure | |
|---|---|
| | GTTTTCAAGGAAGACCTGTTGCGGTAAAGAGAATGTTAATTGATT TTTGTGACATAGCTTTAATGGAAATAAAACTTTTGACTGAAAGCG ATGATCACCCTAACGTCATACGATACTACTGTTCAGAAACAACAG ACAGATTTTTGTATATTGCTTTAGAGCTCTGCAATTTGAACCTTC AAGATTTGGTGGAGTCTAAGAATGTATCAGATGAAAACCTGAAAT TACAGAAAGAGTATAATCCAATTTCGTTATTGAGACAAATAGCGT CCGGGGTAGCACATTTACATTCTTTAAAGATTATCCATCGAGATT TAAAGCCTCAAAATATTCTCGTTTCTACTTCGAGTAGGTTTACTG CCGATCAGCAAACAGGAGCAGAAAATCTTCGAATTTTGATATCAG ACTTTGGTCTTTGCAAAAAACTAGACTCTGGTCAGTCTTCATTTA GAACAAATTTGAATAACCCTTCTGGCACAAGTGGTTGGAGGGCCC CAGAGCTGCTTGAAGAATCAAACAATTTGCAGTGCCAAGTCGAAA CGGAACACTCTTCTAGTAGGCATACAGTAGTTTCATCTGATTCTT TTTATGATCCGTTCACCAAGAGGAGGCTAACAAAGGGAAGCATCC ATTTGGAGATAAATATTCACGTGAAAGCAATATCATAAGAGGAAT ATTCAGTCTTGATGAAATGAAATGTCTACATGATAGATCCTTAAT TGCAGAAGCTACAGATCTGATCTCCCAAATGATTGATCACGATCC GTTAAAAAGACCTACTGCTATGAAAGTTCTAAGGCATCCGTTGTT TTGGCCAAAGTCGAAAAAATTGGAGTTCCTTTTAAAAGTTAGTGA TAGGCTTGAAATTGAAAACAGAGACCCTCCAAGTGCCCTGTTAAT GAAATTTGACGCCGGTTCTGACTTTGTAATACCCAGTGGAGATTG GACTGTCAAGTTTGATAAAACATTCATGGACAACCTTGAAAGGTA CAGAAAATACCATTCATCAAAGTTAATGGATCTATTAAGAGCACT TAGGAATAAATATCATCATTTTATGGATTTACCTGAAGATATAGC AGAACTAATGGGGCCGGTACCCGATGGATTTTACGATTACTTCAC CAAGCGTTTTCCAAACCTATTAATAGGTGTTTATATGATTGTCAA GGAAAATTTAAGTGACGATCAAATTTTACGTGAATTTTTGTATTC ATAA |
| SEQ ID NO: 11<br>IRE1<br>*Saccharomyces* sp. | MRLLRRNMLVLTLLVCVFSSIISCSIPLSSRTSRRQIVEDEVAST KKLNFNYGVDKNINSPIPAPRTTEGLPNMKLSSYPTPNLLNTADN RRANKKGRRAANSISVPYLENRSLNELSLSDILIAADVEGGLHAV DRRNGHIIWSIEPENFQPLIEIQEPSRLETYETLIIEPFGDGNIY YFNAHQGLQKLPLSIRQLVSTSPLHLKTNIVVNDSGKIVEDEKVY TGSMRTIMYTINMLNGEIISAFGPGSKNGYFGSQSVDCSPEEKIK LQECENMIVIGKTIEELGIHSYDGASYNVTYSTWQQNVLDVPLAL QNTFSKDGMCIAPFRDKSLLASDLDFRIARWVSPTFPGIIVGLFD VFNDLRTNENILVPHPFNPGDHESISSNKVYLDQTSNLSWFALSS QNFPSLVESAPISRYASSDRWRVSSIFEDETLFKNAIMGVHQIYN NEYDHLYENYEKTNSLDTTHKYPPLMIDSSVDTTDLHQNNEMNSL KEYMSPEDLEAYRKKIHEQISRELDEKNQNSLLLKFGSLVYRIIE TGVFLLLFLIFCAILQRFKILPPLYVLLSKIGFMPEKEIPIVESK SLNCPSSSENVTKPFDMKSGKQVVFEGAVNDGSLKSEKDNDDADE DDEKSLDLTTEKKKRKRGSRGGKKGRKSRIANIPNFEQSLKNLVV SEKILGYGSSGTVVFQGSFQGRPVAVKRMLIDFCDIALMEIKLLT ESDDHPNVIRYYCSETTDRFLYIALELCNLNLQDLVESKNVSDEN LKLQKEYNPISLLRQIASGVAHLHSLKIIHRDLKPQNILVSTSSR FTADQQTGAENLRILISDFGLCKKLDSGQSSFRTNLNNPSGTSGW RAPELLEESNNLQCQVETEHSSSRHTVVSSDSFYDPFTKRRLTRS IDIFSMGCVFYYILSKGKHPFGDKYSRESNIIRGIFSLDEMKCLH DRSLIAEATDLISQMIDHDPLKRPTAMKVLRHPLFWPKSKKLEFL LKVSDRLEIENRDPPSALLMKFDAGSDFVIPSGDWTVKFDKTFMD NLERYRKYHSSKLMDLLRALRNKYHHFMDLPEDIAELMGPVPDGF YDYFTKRFPNLLIGVYMIVKENLSDDQILREFLYS* |
| SEQ ID NO: 12<br>rot2<br>*Saccharomyces* sp. | ATGGTCCTTTTGAAATGGCTCGTATGCCAATTGGTCTTCTTTACC GCTTTTTCGCATGCGTTTACCGACTATCTATTAAAGAAGTGTGCG CAATCTGGGTTTTGCCATAGAAACAGGGTTTATGCAGAAAATATT GCCAAATCTCATCACTGCTATTACAAAGTGGACGCCGAGTCTATT GCACACGATCCTTTAGAGAATGTGCTTCATGCTACCATAATTAAA ACTATACCAAGATTGGAGGGCGATGATATAGCCGTTCAGTTCCCA TTCTCTCTCTCTTTTTTACAGGATCACTCAGTAAGGTTCACTATA AATGAGAAAGAGAGAATGCCAACCAACAGCAGCGGTTTGTTGATC TCTTCACAACGGTTCAATGAGACCTGGAAGTACGCATTCGACAAG AAATTTCAAGAGGAGGCGAACAGGACCAGTATTCCACAATTCCAC TTCCTTAAGCAAAAACAAACTGTGAACTCATTCTGGTCGAAAATA TCTTCATTTTTGTCACTTTCAAACTCCACTGCAGACACATTTCAT CTTCGAAACGGTGATGTATCCGTAGAAATCTTTGCTGAACCTTTT CAATTGAAAGTTTACTGGCAAAATGCGCTGAAACTTATTGTAAAC GAGCAAAATTTCCTGAACATTGAACATCATAGAACTAAGCAGGAA AACTTCGCACACGTGCTGCCAGAAGAAACAACTTTCAACATGTTT AAGGACAATTTCTTGTATTCAAAGCATGACTCTATGCCTTTGGGG CCTGAATCGGTTGCGCTAGATTTCTCTTTCATGGGTTCTACTAAT GTCTACGGTATACCGGAACATGCGACGTCGCTAAGGCTGATGGAC ACTTCAGGTGGAAAGGAACCCTACAGGCTTTTCAACGTTGATGTC TTTGAGTACAACATCGGTACCAGCCAACCAATGTACGGTTCGATC CCATTCATGTTTTCATCTTCGTCCACATCTATCTTTTGGGTCAAT GCAGCTGACACTTGGGTAGACATAAAGTATGACACCAGTAAAAAT |

TABLE 1-continued

| Amino acid and nucleotide sequences of the disclosure | |
|---|---|
| | AAAACGATGACTCATTGGATCTCCGAAAATGGTGTCATAGATGTA<br>GTCATGTCCCTGGGGCCAGATATTCCAACTATCATTGACAAATTT<br>ACCGATTTGACTGGTAGACCCTTTTTACCGCCCATTTCCTCTATA<br>GGGTACCATCAATGTAGATGGAATTATAATGATGAGATGGACGTT<br>CTCACAGTGGACTCTCAGATGGATGCTCATATGATTCCTTACGAT<br>TTTATTTGGTTGGACTTGGAGTATACGAACGACAAAAAATATTTT<br>ACTTGGAAGCAGCACTCCTTTCCCAATCCAAAAAGGCTGTTATCC<br>AAATTAAAAAAGTTGGGTAGAAATCTTGTCGTACTAATCGATCCT<br>CATTTAAAGAAAGATTATGAAATCAGTGACAGGGTAATTAATGAA<br>AATGTAGCAGTCAAGGATCACAATGGAAATGACTATGTAGGTCAT<br>TGCTGGCCAGGTAATTCTATATGGATTGATACCATAAGCAAATAT<br>GGCCAAAAGATTTGGAAGTCCTTTTTCGAACGGTTTATGGATCTG<br>CCGGCTGATTTAACTAATTTATTCATTTGGAATGATATGAACGAG<br>CCTTCGATTTTCGATGGCCCAGAGACCACAGCTCCAAAAGATTTG<br>ATTCACGACAATTACATTGAGGAAAGATCCGTCCATAACATATAT<br>GGTCTATCAGTGCATGAAGCTACTTACGACGCAATAAAATCGATT<br>TATTCACCATCCGATAAGCGTCCTTTCCTTCTTGACAATGTGGCC<br>AATTGGGATTACTTAAAGATTTCCATTCCTATGGTTCTGTCAAAC<br>AACATTGCTGGTATGCCATTTATAGGAGCCGACATAGCTGGCTTT<br>GCTGAGGATCCTACACCTGAATTGATTGCACGTTGGTACCAAGCG<br>GGCTTATGGTACCCATTTTTTAGAGCACACGCCCATATAGACACC<br>AAGAGAAGAGAACCATACTTATTCAATGAACCTTTGAAGTCGATA<br>GTACGTGATATTATCCAATTGAGATATTTCCTGCTACCTACCTTA<br>TACACCATGTTTCATAAATCAAGTGTCACTGGATTTCCGATAATG<br>AATCCAATGTTTATTGAACACCCTGAATTTGCTGAATTGTATCAT<br>ATCGATAACCAATTTTACTGGAGTAATTCAGGTCTATTAGTCAAA<br>CCTGTCACGGAGCCTGGTCAATCAGAAACGGAAATGGTTTTCCCA<br>CCCGGTATATTCTATGAATTCGCATCTTTACACTCTTTTATAAAC<br>AATGGTACTGATTTGATAGAAAAGAATATTTCTGCACCATTGGAT<br>AAAATTCCATTATTTATTGAAGGCGGTCACATTATCACTATGAAA<br>GATAAGTATAGAAGATCTTCAATGTTAATGAAAAACGATCCATAT<br>GTAATAGTTATAGCCCCTGATACCGAGGGACGAGCCGTTGGAGAT<br>CTTTATGTTGATGATGGAGAAACTTTTGGCTACCAAAGAGGTGAG<br>TACGTAGAAACTCAGTTCATTTTCGAAAACAATACCTTAAAAAAT<br>GTTCGAAGTCATATTCCCGAGAATTTGACAGGCATTCACCACAAT<br>ACTTTGAGGAATACCAATATTGAAAAAATCATTATCGCAAAGAAT<br>AATTTACAACACAACATAACGTTGAAAGACAGTATTAAAGTCAAA<br>AAAAATGGCGAAGAAAGTTCATTGCCGACTAGATCGTCATATGAG<br>AATGATAATAAGATCACCATTCTTAACCTATCGCTTGACATAACT<br>GAAGATTGGGAAGTTATTTTTTGA |
| SEQ ID NO: 13<br>rot2<br>*Saccharomyces* sp. | MVLLKWLVCQLVFFTAFSHAFTDYLLKKCAQSGFCHRNRVYAENI<br>AKSHHCYYKVDAESIAHDPLENVLHATIIKTIPRLEGDDIAVQFP<br>FSLSFLQDHSVRFTINEKERMPTNSSGLLISSQRFNETWKYAFDK<br>KFQEEANRTSIPQFHFLKQKQTVNSFWSKISSFLSLSNSTADTFH<br>LRNGDVSVEIFAEPFQLKVYWQNALKLIVNEQNFLNIEHHRTKQE<br>NFAHVLPEETTFNMFKDNFLYSKHDSMPLGPESVALDFSFMGSTN<br>VYGIPEHATSLRLMDTSGGKEPYRLFNVDWEYNIGTSQPMYGSIP<br>FMFSSSSTSIFWVNAADTWVDIKYDTSKNKTMTHWISENGVIDVV<br>MSLGPDIPTIIDKFTDLTGRPFLPPISSIGYHQCRWNYNDEMDVL<br>TVDSQMDAHMIPYDFIWLDLEYTNDKKYFTWKQHSFPNPKRLLSK<br>LKKLGRNLVVLIDPHLKKDYEISDRVINENVAVKDHNGNDYVGHC<br>WPGNSIWIDTISKYGQKIWKSFFERFMDLPADLTNLFIWNDMNEP<br>SIFDGPETTAPKDLIHDNYIEERSVHNIYGLSVHEATYDAIKSIY<br>SPSDKRPFLLTRAFFAGSQRTAATWTGDNVANWDYLKISIPMVLS<br>NNIAGMPFIGADIAGFAEDPTPELIARWYQAGLWYPFFRAHAHID<br>TKRREPYLFNEPLKSIVRDIIQLRYFLLPTLYTMFHKSSVTGFPI<br>MNPMFIEHPEFAELYHIDNQFYWSNSGLLVKPVTEPGQSETEMVF<br>PPGIFYEFASLHSFINNGTDLIEKNISAPLDKIPLFIEGGHIITM<br>KDKYRRSSMLMKNDPYVIVIAPDTEGRAVGDLYVDDGETFGYQRG<br>EYVETQFIFENNTLKNVRSHIPENLTGIHHNTLRNTNIEKIIIAK<br>NNLQHNITLKJDSIKVKKNGEESSLPTRSSYENDNKITILNLSLD<br>ITEDWEVIF* |
| SEQ ID NO: 14<br>Pep4<br>*Saccharomyces* sp. | ATGTTCAGCTTGAAAGCATTATTGCCATTGGCCTTGTTGTTGGTC<br>AGCGCCAACCAAGTTGCTGCAAAAGTCCACAAGGCTAAAATTTAT<br>AAACACGAGTTGTCCGATGAGATGAAAGAAGTCACTTTCGAGCAA<br>CATTTAGCTCATTTAGGTAGGGAGCATCCTTTCTTCACTGAAGGT<br>GGTCACGATGTTCCATTGACAAATTACTTGAACGCACAATATTAC<br>ACTGACATTACTTTGGGTACTCCACCTCAAAACTTCAAGGTTATT<br>TTGGATACTGGTTCTTCAAACCTTTGGGTTCCAAGTAACGAATGT<br>GGTTCCTTGGCTTGTTTCCTACATTCTAAATACGATCATGAAGCT<br>TCATCAAGCTACAAAGCTAATGGTACTGAATTTGCCATTCAATAT<br>GGTACTGGTTCTTTGGAAGGTTACATTTCTCAAGACACTTTGTCC<br>ATCGGGGATTTGACCATTCCAAAACAAGACTTCGCTGAGGCTACC<br>AGCGAGCCGGGCTTAACATTTGCATTTGGCAAGTTCGATGGTATT<br>TTGGGTTTGGGTTACGATACCATTTCTGTTGATAAGGTGGTCCCT<br>CCATTTTACAACGCCATTCAACAAGATTTGTTGGACGAAAAGAGA |

TABLE 1-continued

| Amino acid and nucleotide sequences of the disclosure | |
|---|---|
| | TTTGCCTTTTATTTGGGAGACACTTCAAAGGATACTGAAAATGGC<br>GGTGAAGCCACCTTTGGTGGTATTGACGAGTCTAAGTTCAAGGGC<br>GATATCACTTGGTTACCTGTTCGTCGTAAGGCTTACTGGGAAGTC<br>AAGTTTGAAGGTATCGGTTTAGGCGACGAGTACGCCGAATTGGAG<br>AGCCATGGTGCCGCCATCGATACTGGTACTTCTTTGATTACCTTG<br>CCATCAGGATTAGCTGAAATGATTAATGCTGAAATTGGGGCCAAG<br>AAGGGTTGGACCGGTCAATATACTCTAGACTGTAACACCAGAGAC<br>AATCTACCTGATCTAATTTTCAACTTCAATGGCTACAACTTCACT<br>ATTGGGCCATACGATTACACGCTTGAAGTTTCAGGCTCCTGTATC<br>TCTGCAATTACACCAATGGATTTCCCAGAACCTGTTGGCCCACTG<br>GCCATCGTTGGTGATGCCTTCTTGCGTAAATACTATTCTATTTAC<br>GATTTGGGCAACAATGCGGTTGGTTTGGCCAAAGCAATTTGA |
| SEQ ID NO: 15<br>pep4<br>*Saccharomyces* sp. | MFSLKALLPLALLLVSANQVAAKVHKAKIYKHELSDEMKEVTFEQ<br>HLAHLGQKYLTQFEKANPEWFSREHPFFTEGGHDVPLTNYLNAQY<br>YTDITLGTPPQNFKVILDTGSSNLWVPSNECGSLACFLHSKYDHE<br>ASSSYKANGTEFAIQYGTGSLEGYISQDTLSIGDLTIPKQDFAEA<br>TSEPGLTFAFGKFDGILGLGYDTISVDKVVPPFYNAIQQDLLDEK<br>RFAFYLGDTSKDTENGGEATFGGIDESKFKGDITWLPVRRKAYWE<br>VKFEGIGLGDEYAELESHGAAIDTGTSLITLPSGLAEMINAEIGA<br>KKGWTGQYTLDCNTRDNLPDLIFNFNGYNFTIGPYDYTLEVSGSC<br>ISAITPMDFPEPVGPLAIVGDAFLRKYYSIYDLGNNAVGLAKAI* |
| SEQ ID NO: 16<br>Geranyl<br>pyrophosphate<br>olivetolic acid<br>geranyltransferase<br>CsPT4 nucleotide<br>sequence<br>(GOT)<br>Artificial sequence<br>Codon optimized | ATGGGTTTATCTTTGGTCTGCACCTTCTCCTTTCAAACTAACTAC<br>CACACTTTATTGAATCCACATAATAAGAATCCTAAGAACTCTTTA<br>TTGTCCTACCAACACCCAAAGACTCCTATTATCAAGTCCTCTTAC<br>GATAACTTCCCATCTAAGTACTGTTTGACTAAGAATTTCCATTTG<br>TTGGGTTTGAATTCTCACAACAGAATTTCCTCCCAATCCCGTTCT<br>ATTAGAGCCGGTTCTGATCAAATCGAAGGTTCCCCTCATCATGAG<br>TCCGATAACTCCATTGCTACTAAAATTTTAAATTTCGGTCATACT<br>TGTTGGAAGTTGCAACGTCCTTACGTTGTCAAGGGTATGATCTCT<br>ATTGCTTGTGGTTTGTTCGGTAGAGAATTGTTTAACAACAGACAC<br>TTGTTCTCTTGGGGTTTGATGTGGAAAGCTTTCTTCGCTTTGGTC<br>CCAATTTTGTCTTTCAATTTCTTCGCCGCCATCATGAACCAAATC<br>TACGATGTTGATATCGACCGTATCAACAAGCCAGACTTACCTTTA<br>GTTTCCGGTGAAATGTCCATTGAAACTGCTTGGATCTTGTCTATC<br>ATTGTTGCCTTGACTGGTTTAATTGTTACTATTAAGTTGAAGTCC<br>GCTCCATTGTTTGTCTTCATCTACATCTTCGGTATCTTCGCTGGT<br>TTCGCTTACTCCGTCCCACCTATTAGATGGAAACAATATCCTTTT<br>ACCAATTTCTTGATCACTATTTCCTCTCATGTTGGTTTGGCTTTC<br>ACTTCTTACTCTGCCACCACTTCTGCTTTAGGTTTGCCTTTCGTT<br>TGGCGTCCTGCCTTCTCTTTCATTATTGCTTTCATGACTGTCATG<br>GGTATGACTATTGCCTTTGCTAAAGACATTTCTGATATCGAAGGT<br>GATGCTAAGTACGGTGTCTCTACCGTTGCTACCAAGTTAGGTGCT<br>AGAAATATGACTTTTGTTGTTTCTGGTGTCTTATTGTTGAACTAC<br>TTGGTTTCTATCTCTATTGGTATCATTTGGCCACAAGTTTTCAAG<br>TCTAACATTATGATCTTGTCTCATGCTATTTTGGCTTTCTGTTTG<br>ATCTTTCAAACTCGTGAATTAGCCTTAGCCAATTATGCCTCTGCC<br>CCATCCCGTCAATTTTTCGAATTCATCTGGTTGTTATACTATGCC<br>GAATACTTCGTTTACGTCTTCATTTAA |
| SEQ ID NO: 17<br>Geranyl pyrophosphate<br>olivetolic acid<br>geranyltransferase<br>CsPT4<br>(GOT)<br>*Cannibis sativa* | MGLSLVCTFSFQTNYHTLLNPHNKNPKNSLLSYQHPKTPIIKSSY<br>DNFPSKYCLTKNFHLLGLNSHNRISSQSRSIRAGSDQIEGSPHHE<br>SDNSIATKILNFGHTCWKLQRPYWKGMISIACGLFGRELFNNRHL<br>FSWGLMWKAFFALVPILSFNFFAAIMNQIYDVDIDRINKPDLPLV<br>SGEMSIETAWILSIIVALTGLIVTIKLKSAPLFVFIYIFGIFAGF<br>AYSVPPIRWKQYPFTNFLITISSHVGLAFTSYSATTSALGLPFVW<br>RPAFSFIIAFMTVMGMTIAFAKDISDIEGDAKYGVSTVATKLGAR<br>NMTFVVSGVLLLNYLVSISIGIIWPQVFKSNIMILSHAILAFCLI<br>FQTRELALANYASAPSRQFFEFIWLLYYAEYFVYVFI* |
| SEQ ID NO: 18<br>Tetraketide synthase<br>(TKS) nucleotide<br>sequence<br>Artificial sequence<br>Codon optimized | ATGAACCATTTAAGAGCTGAGGGTCCAGCTTCCGTCTTGGCTATC<br>GGTACTGCTAATCCAGAGAACATTTTATTACAAGATGAGTTTCCA<br>GATTACTATTTCCGTGTTACTAAGTCCGAGCATATGACCCAATTG<br>AAAGAAAAGTTCCGTAAAATCTGTGATAAATCTATGATTAGAAAA<br>AGAAACTGCTTTTTAAACGAAGAACACTTGAAGCAAAACCCAAGA<br>TTAGTTGAACACGAGATGCAAACCTTGGACGCTAGACAAGATATG<br>TTGGTTGTCGAGGTTCCTAAATTGGGTAAAGACGCCTGTGCTAAA<br>GCTATCAAAGAGTGGGGTCAACCTAAGTCCAAGATCACTCACTTA<br>ATCTTCACTTCCGCTTCCACCACTGACATGCCTGGTGCTGATTAC<br>CACTGTGCCAAGTTGTTGGGTTTGTCTCCTTCTGTCAAGAGAGTT<br>ATGATGTACCAATTAGGTTGTTACGGTGGTGGTACTGTCTTAAGA<br>ATTGCTAAGGACATCGCTGAAAACAACAAAGGTGCTAGAGTTTTA<br>GCCGTTTGTTGTGACATCATGGCTTGTTTATTTCGTGGTCCATCT<br>GAATCTGACTTGGAGTTGTTGGTTGGTCAAGCTATTTTTGGTGAT<br>GGTGCCGCTGCCGTCATCGTTGGTGCTGAGCCAGATGAATCCGTT<br>GGTGAAAGACCAATTTTCGAATTAGTCTCTACTGGTCAAACTATT<br>TTGCCAAACTCCGAGGGTACTATCGGTGGTCATATTCGTGAAGCC |

TABLE 1-continued

| Amino acid and nucleotide sequences of the disclosure | |
|---|---|
| | GGTTTAATCTTTGATTTGCACAAAGACGTTCCAATGTTGATCTCT<br>AACAACATCGAAAAGTGTTTAATTGAGGCTTTTACTCCAATTGGT<br>ATCTCTGACTGGAACTCTATCTTCTGGATCACTCATCCAGGTGGT<br>AAGGCTATCTTGGACAAGGTTGAAGAAAAATTACATTTAAAGTCC<br>GATAAATTCGTCGATTCTCGTCATGTTTTGTCTGAACACGGTAAC<br>ATGTCTTCCTCCACTGTCTTGTTTGTTATGGATGAATTACGTAAG<br>AGATCTTTGGAGGAGGGTAAGTCTACTACTGGTGATGGTTTCGAA<br>TGGGGTGTTTTGTTCGGTTTCGGTCCTGGTTTGACTGTTGAACGT<br>GTTGTTGTTAGATCTGTTCCAATTAAGTACTAG |
| SEQ ID NO: 19<br>Tetraketide<br>synthase<br>(TKS)<br>GenBank B1Q2B6<br>*Cannabis sativa* | MNHLRAEGPASVLAIGTANPENILLQDEFPDYYFRVTKSEHMTQL<br>KEKFRKICDKSMIRKRNCFLNEEHLKQNPRLVEHEMQTLDARQDM<br>LVVEVPKLGKDACAKAIKEWGQPKSKITHLIFTSASTTDMPGADY<br>HCAKLLGLSPSVKRVMMYQLGCYGGGTVLRIAKDIAENNKGARVL<br>AVCCDIMACLFRGPSESDLELLVGQAIFGDGAAAVIVGAEPDESV<br>GERPIFELVSTGQTILPNSEGTIGGHIREAGLIFDLHKDVPMLIS<br>NNIEKCLIEAFTPIGISDWNSIFWITHPGGKAILDKVEEKLHLKS<br>DKFVDSRHVLSEHGNMSSSTVLFVMDELRKRSLEEGKSTTGDGFE<br>WGVLFGFGPGLTVERVVVRSVPIKY* |
| SEQ ID NO: 20<br>Olivetolic acid<br>cyclase<br>(OAC) nucleotide<br>sequence<br>Artificial<br>Sequence<br>Codon optimized | ATGGCCGTCAAACACTTGATCGTCTTAAAATTCAAGGATGAAATT<br>ACTGAAGCTCAAAAAGAAGAGTTCTTCAAAACCTATGTCAATTTA<br>GTCAACATTATTCCTGCTATGAAGGACGTTTACTGGGGTAAGGAT<br>GTCACCCAAAAGAACAAGGAAGAAGGTTACACTCACATTGTTGAA<br>GTCACTTTCGAATCTGTTGAAACTATCCAAGATTATATTATCCAC<br>CCAGCTCATGTCGGTTTTGGTGATGTTTACAGATCTTTTTGGGAA<br>AAATTGTTGATCTTTGACTATACTCCAAGAAAATAA |
| SEQ ID NO: 21<br>Olivetolic acid<br>cyclase<br>(OAC)<br>GenBank AFN42527<br>*Cannabis sativa* | MAVKHLIVLKFKDEITEAQKEEFFKTYVNLVNIIPAMKDVYWGKD<br>VTQKNKEEGYTHIVEVTFESVETIQDYIIHPAHVGFGDVYRSFWE<br>KLLIFDYTPRK* |
| SEQ ID NO: 22<br>Acyl-activating<br>enzyme<br>Cs_AAE1<br>nucleotide<br>sequence<br>Artificial<br>sequence<br>Codon optimized | ATGGGTAAGAATTACAAGTCCTTAGACTCTGTTGTTGCTTCTGAC<br>TTTATTGCTTTAGGTATTACTTCCGAAGTTGCTGAAACCTTACAC<br>GGTAGATTGGCTGAAATTGTTTGCAACTACGGTGCTGCTACCCCT<br>CAAACTTGGATTAACATTGCTAATCATATTTTGTCTCCAGATTTG<br>CCATTTTCTTTACACCAAATGTTGTTCTACGGTTGTTACAAGGAT<br>TTCGGTCCTGCTCCTCCAGCTTGGATTCCTGATCCAGAAAAAGTC<br>AAATCTACTAACTTGGGTGCTTTGTTGGAAAAGAGAGGTAAGGAG<br>TTTTTGGGTGTTAAGTACAAGGACCCAATTTCTTCTTTCTCTCAC<br>TTCCAAGAATTCTCTGTTAGAAACCCTGAAGTTTACTGGAGAACT<br>GTTTTGATGGATGAGATGAAGATTTCTTTTTCTAAGGACCCAGAG<br>TGTATCTTAAGAAGAGACGACATTAACAATCCAGGTGGTTCTGAG<br>TGGTTACCAGGTGGTTACTTGAACTCTGCCAAAAATTGCTTGAAC<br>GTTAACTCTAACAAGAAATTGAATGACACTATGATTGTCTGGAGA<br>GATGAGGGTAACGATGATTTGCCTTTGAATAAATTGACTTTGGAT<br>CAATTGAGAAAAAGAGTCTGGTTGGTTGGTTACGCTTTGGAAGAA<br>ATGGGTTTAGAAAAAGGTTGTGCTATCGCCATCGATATGCCTATG<br>CACGTTGATGCTGTTGTTATTTATTTGGCTATTGTTTTAGCTGGT<br>TATGTTGTTGTTTCCATCGCCGACTCCTTCTCTGCTCCAGAAATC<br>TCCACCAGATTGAGATTGTCTAAAGCCAAAGCCATTTTCACCCAA<br>GACCACATCATTAGAGGTAAGAAGCGTATTCCATTGTATTCTCGT<br>GTTGTTGAAGCTAAATCTCCTATGGCTATCGTCATCCCATGCTCT<br>GGTTCTAACATCGGTGCTGAATTAAGAGACGGTGATATTTCTTGG<br>GACTACTTTTTAGAAAGAGCTAAAGAATTCAAAAACTGCGAGTTT<br>ACTGCTAGAGAACAACCTGTCGACGCTTATACTAATATTTTATTC<br>TCTTCTGGTACTACTGGTGAACCTAAGGCTATTCCATGGACCCAA<br>GCTACTCCTTTGAAAGCCGCTGCTGATGGTTGGTCCCATTTAGAC<br>ATCAGAAAAGGTGATGTCATCGTCTGGCCAACTAACTTAGGTTGG<br>ATGATGGGTCCATGGTTAGTCTACGCTTCTTTGTTGAATGGTGCC<br>TCTATCGCCTTATATAATGGTTCCCCTTTAGTCTCTGGTTTTGCT<br>AAATTCGTTCAAGATGCTAAGGTTACCATGTTAGGTGTTGTCCCT<br>TCTATCGTTAGATCTTGGAAATCTACTAACTGTGTTTCTGGTTAC<br>GACTGGTCCACTATTCGTTGTTTCTCTTCTTCTGGTGAAGCTTCC<br>AATGTCGATGAGTACTTATGGTTAATGGGTCGTGCTAACTACAAG<br>CCAGTCATCGAAATGTGCGGTGGTACTGAAATTGGTGGTGCTTTT<br>TCCGCTGGTTACTTTATATATCTTAGATAAGAATGGTTACCCTAT<br>GCCTAAAAACAAGCCAGGTATTGGTGAATTAGCTTTGGGTCCTGT<br>TATGTTTGGTGCTTCTAAAACCTTGTTAAATGGTAATCATCACGA<br>CGTTTACTTCAAAGGTATGCCTACTTTGAACGGTGAGGTTTTGAG<br>ACGTCATGGTGATATTTTCGAATTAACTTCCAACGGTTATTATCA<br>CGCTCACGGTAGAGCTGATGATACTATGAACATTGGTGGTATTAA<br>GATCTCTTCCATCGAAATTGAGAGAGTTTGTAACGAGGTTGACGA<br>TCGTGTTTTCGAAACTACTGCTATTGGTGTCCCTCCTTTAGGTGG |

TABLE 1-continued

| Amino acid and nucleotide sequences of the disclosure | |
|---|---|
| | TGGTCCAGAACAATTGGTTATCTTTTTCGTCTTGAAGGACTCCAA<br>CGACACCACTATCGACTTAAACCAATTAAGATTGTCTTTCAACTT<br>GGGTTTGCAAAAGAAGTTGAATCCATTATTTAAGGTTACTCGTGT<br>CGTTCCATTGTCCTCCTTGCCAAGAACTGCTACCAACAAGATTAT<br>GCGTAGAGTCTTGAGACAACAATTCTCTCACTTTGAGTAA |
| SEQ ID NO: 23<br>Acyl-activating<br>enzyme<br>(CsAAE1)<br>*Cannabis sativa* | MGKNYKSLDSWASDFIALGITSEVAETLHGRLAETVCNYGAATP<br>QTWINIANHILSPDLPFSLHQMLFYGCYKDFGPAPP<br>AWIPDPEKVKSTNLGALLEKRGKEFLGVKYKDPISSFSHFQEFSV<br>RNPEVYWRTVLMDEMKISFSKDPECILRRDDINNPGGSEWLPGGY<br>LNSAKNCLNVNSNKKLNDTMIVWRDEGNDDLPLNKLTLDQLRKRV<br>WLVGYALEEMGLEKGCAIAIDMPMHVDAWIYLAIVLAGYWVSIAD<br>SFSAPEISTRJLRLSKAKAIFTQDHIIRGKKRIPLYSRVVEAKSP<br>MAIVIPCSGSNIGAELRDGDISWDYFLERAKEFKNCEFTAREQPV<br>DAYTNILFSSGTTGEPKAIPWTQATPLKAAADGWSHLDIRKGDVI<br>VWPTNLGWMMGPWLVYASLLNGASIALYNGSPLVSGFAKFVQDAK<br>VTMLGWPSIVRSWKSTNCVSGYDWSTIRCFSSSGE<br>ASNVDEYLWLMGRANYKPVIEMCGGTEIGGAFSAGSFLQAQSLSS<br>FSSQCMGCTLYILDKNGYPMPKNKPGIGELALGPVMFGASKTLLN<br>GNHHDVYFKGMPTLNGEVLRRHGDIFELTSNGYYHAHGRADDTMN<br>IGGIKISSIEIERVCNEVDDRVFETTAIGWPLGGGPEQLVIFFVL<br>KDSNDTTIDLNQLRLSFNLGLQKKLNPLFKVTRVVPLSSLPRTAT<br>NKiMRRVLRQQFSHFE* |
| SEQ ID NO: 24<br>Isopentenyl<br>pyrophosphate<br>isomerase<br>(Sc_IDI1)<br>*Saccharomyces* sp. | ATGACTGCCGACAACAATAGTATGCCCCATGGTGCAGTATCTAGT<br>TACGCCAAATTAGTGCAAAACCAAACACCTGAAGACATTTTGGAA<br>GAGTTTCCTGAAATTATTCCATTACAACAAAGACCTAATACCCGA<br>TCTAGTGAGACGTCAAATGACGAAAGCGGAGAAACATGTTTTTCT<br>GGTCATGATGAGGAGCAAATTAAGTTAATGAATGAAAATTGTATT<br>GTTTTGGATTGGGACGATAATGCTATTGGTGCCGGTACCAAGAAA<br>GTTTGTCATTTAATGGAAAATATTGAAAAGGGTTTACTACATCGT<br>GCATTCTCCGTCTTTATTTTCAATGAACAAGGTGAATTACTTTTA<br>CAACAAAGAGCCACTGAAAAAATAACTTTCCCTGATCTTTGGACT<br>AACACATGCTGCTCTCATCCACTATGTATTGATGACGAATTAGGT<br>TTGAAGGGTAAGCTAGACGATAAGATTAAGGGCGCTATTACTGCG<br>GCGGTGAGAAAACTAGATCATGAATTAGGTATTCCAGAAGATGAA<br>ACTAAGACAAGGGGTAAGTTTCACTTTTTAAACAGAATCCATTAC<br>ATGGCACCAAGCAATGAACCATGGGGTGAACATGAAATTGATTAC<br>ATCCTATTTTATAAGATCAACGCTAAAGAAAACTTGACTGTCAAC<br>CCAAACGTCAATGAAGTTAGAGACTTCAAATGGGTTTCACCAAAT<br>GATTTGAAAACTATGTTTGCTGACCCAAGTTACAAGTTTACGCCT<br>TGGTTTAAGATTATTTGCGAGAATTACTTATTCAACTGGTGGGAG<br>CAATTAGATGACCTTTCTGAAGTGGAAAATGACAGGCAAATTCAT<br>AGAATGCTATAA |
| SEQ ID NO: 25<br>Isopentenyl<br>pyrophosphate<br>isomerase<br>(Sc_IDI1)<br>*Saccharomyces* sp. | MTADNNSMPHGAVSSYAKLVQNQTPEDILEEFPEIIPLQQRPNTR<br>SSETSNDESGETCFSGHDEEQIKLMNENCIVLDWDDNAIGAGTKK<br>VCHLMENIEKGLLHRAFSWIFNEQGELLLQQRATEKITFPDLWTN<br>TCCSHPLCIDDELGLKGKLDDKIKGAITAAVRKLDHELGIPEDET<br>KTRGKFHFLNRIHYMAPSNEPWGEHEIDYILFYKINAKENLTVNP<br>NVNEVRDFKWVSPNDLKTMFADPSYKFTPWFKIICENYLFNWWEQ<br>LDDLSEVENDRQIHRML* |
| SEQ ID NO: 26<br>Truncated<br>3-hydroxy-3-<br>methyl-glutaryl-<br>CoA<br>reductase<br>(tHMG1,<br>tHMGR)<br>Artificial<br>sequence | ATGCAATTGGTGAAGACTGAAGTCACCAAGAAGTCTTTTACTGCT<br>CCTGTACAAAAGGCTTCTACACCAGTTTTAACCAATAAAACAGTC<br>ATTTCTGGATCGAAAGTCAAAAGTTTATCATCTGCGCAATCGAGC<br>TCATCAGGACCTTCATCATCTAGTGAGGAAGATGATTCCCGCGAT<br>ATTGAAAGCTTGGATAAGAAAATACGTCCTTTAGAAGAATTAGAA<br>GCATTATTAAGTAGTGGAAATACAAAACAATTGAAGAACAAAGAG<br>GTCGCTGCCTTGGTTATTCACGGTAAGTTACCTTTGTACGCTTTG<br>GAGAAAAAATTAGGTGATACTACGAGAGCGGTTGCGGTACGTAGG<br>AAGGCTCTTTCAATTTTGGCAGAAGCTCCTGTATTAGCATCTGAT<br>CGTTTACCATATAAAAATTATGACTACGACCGCGTATTTGGCGCT<br>TGTTGTGAAAATGTTATAGGTTACATGCCTTTGCCCGTTGGTGTT<br>ATAGGCCCCTTGGTTATCGATGGTACATCTTATCATATACCAATG<br>GCAACTACAGAGGGTTGTTTGGTAGCTTCTGCCATGCGTGGCTGT<br>AAGGCAATCAATGCTGGCGGTGGTGCAACAACTGTTTTAACTAAG<br>GATGGTATGACAAGAGGCCCAGTAGTCCGTTTCCCAACTTTGAAA<br>AGATCTGGTGCCTGTAAGATATGGTTAGACTCAGAAGAGGGACAA<br>AACGCAATTAAAAAAGCTTTTAACTCTACATCAAGATTTGCACGT<br>CTGCAACATATTCAAACTTGTCTAGCAGGAGATTTACTCTTCATG<br>AGATTTAGAACAACTACTGGTGACGCAATGGGTATGAATATGATT<br>TCTAAGGGTGTCGAATACTCATTAAAGCAAATGGTAGAAGAGTAT<br>GGCTGGGAAGATATGGAGGTTGTCTCCGTTTCTGGTAACTACTGT<br>ACCGACAAAAAACCAGCTGCCATCAACTGGATCGAAGGTCGTGGT<br>AAGAGTGTCGTCGCAGAAGCTACTATTCCTGGTGATGTTGTCAGA<br>AAAGTGTTAAAAAGTGATGTTTCCGCATTGGTTGAGTTGAACATT<br>GCTAAGAATTTGGTTGGATCTGCAATGGCTGGGTCTGTTGGTGGA |

TABLE 1-continued

| Amino acid and nucleotide sequences of the disclosure | |
|---|---|
| | TTTAACGCACATGCAGCTAATTTAGTGACAGCTGTTTTCTTGGCA TTAGGACAAGATCCTGCACAAAATGTCGAAAGTTCCAACTGTATA ACATTGATGAAAGAAGTGGACGGTGATTTGAGAATTTCCGTATCC ATGCCATCCATCGAAGTAGGTACCATCGGTGGTGGTACTGTTCTA GAACCACAAGGTGCCATGTTGGACTTATTAGGTGTAAGAGGCCCA CATGCTACCGCTCCTGGTACCAACGCACGTCAATTAGCAAGAATA GTTGCCTGTGCCGTCTTGGCAGGTGAATTATCCTTATGTGCTGCC CTAGCAGCCGGCCATTTGGTTCAAAGTCATATGACCCACAACAGG AAACCTGCTGAACCAACAAAACCTAACAATTTGGACGCCACTGAT ATAAATCGTTTGAAAGATGGGTCCGTCACCTGCATTAAATCCTAA |
| SEQ ID NO: 27 Truncated 3-hydroxy-3-methyl-glutaryl-CoA reductase (Sc_tHMG1, tHMGR) Artificial sequence | MQLVKTEVTKKSFTAPVQKASTPVLTNKTVISGSKVKSLSSAQSS SSGPSSSSEEDDSRDIESLDKKIRPLEELEAJLLSSGNTKQLKNK EVAALVIHGKLPLYALEKKLGDTTRAVAVRRKALSILAEAPVLAS DRLPYKNYDYDRVFGACCENVIGYMPLPVGVIGPLVIDGTSYHIP MATTEGCLVASAMRGCKAINAGGGATTVLTKDGMTRGPWRFPTLK RSGACKIWLDSEEGQNAIKKAFNSTSRFARLQHIQTCLAGDLLFM RFRTTTGDAMGMNMISKGVEYSLKQMVEEYGWEDMEVVSVSGNYC TDKKPAAINWIEGRGKSWAEATIPGDVVRKVLKSDVSALVELNIA KNLVGSAMAGSVGGFNAHAANLVTAWLALGQDPAQNVESSNCITL MKEVDGDLRISVSMPSIEVGTIGGGTVLEPQGAMLDLLGVRGPHA TAPGTNARQLARIVACAVLAGELSLCAALAAGHLVQSHMTHNRKP AEPTKPNNLDATDINRLKDGSVTCIKS* |
| SEQ ID NO: 28 HMG-CoA synthase (Sc_ERG13, HMGS) *Saccharomyces* sp. | ATGACTGAACTAAAAAAACAAAAGACCGCTGAACAAAAAACCAGA CCTCAAAATGTCGGTATTAAAGGTATCCAAATTTACATCCCAACT CAATGTGTCAACCAATCTGAGCTAGAGAAATTTGATGGCGTTTCT CAAGGTAAATACACAATTGGTCTGGGCCAAACCAACATGTCTTTT GTCAATGACAGAGAAGATATCTACTCGATGTCCCTAACTGTTTTG TCTAAGTTGATCAAGAGTTACAACATCGACACCAACAAAATTGGT AGATTAGAAGTCGGTACTGAAACTCTGATTGACAAGTCCAAGTCT GTCAAGTCTGTCTTGATGCAATTGTTTGGTGAAAACACTGACGTC GAAGGTATTGACACGCTTAATGCCTGTTACGGTGGTACCAACGCG TTGTTCAACTCTTTGAACTGGATTGAATCTAACGCATGGGATGGT AGAGACGCCATTGTAGTTTGCGGTGATATTGCCATCTACGATAAG GGTGCCGCAAGACCAACCGGTGGTGCCGGTACTGTTGCTATGTGG ATCGGTCCTGATGCTCCAATTGTATTTGACTCTGTAAGAGCTTCT TACATGGAACACGCCTACGATTTTTACAAGCCAGATTTCACCAGC GAATATCCTTACGTCGATGGTCATTTTTCATTAACTTGTTACGTC AAGGCTCTTGATCAAGTTTACAAGAGTTATTCCAAGAAGGCTATT TCTAAAGGGTTGGTTAGCGATCCCGCTGGTTCGGATGCTTTGAAC GTTTTGAAATATTTCGACTACAACGTTTTCCATGTTCCAACCTGT AAATTGGTCACAAAATCATACGGTAGATTACTATATAACGATTTC AGAGCCAATCCTCAATTGTTCCCAGAAGTTGACGCCGAATTAGCT ACTCGCGATTATGACGAATCTTTAACCGATAAGAACATTGAAAAA ACTTTTGTTAATGTTGCTAAGCCATTCCACAAAGAGAGAGTTGCC CAATCTTTGATTGTTCCAACAAACACAGGTAACATGTACACCGCA TCTGTTTATGCCGCCTTTGCATCTCTATTAAACTATGTTGGATCT GACGACTTACAAGGCAAGCGTGTTGGTTTATTTTCTTACGGTTCC GGTTTAGCTGCATCTCTATATTCTTGCAAAATTGTTGGTGACGTC CAACATATTATCAAGGAATTAGATATTACTAACAAATTAGCCAAG AGAATCACCGAAACTCCAAAGGATTACGAAGCTGCCATCGAATTG AGAGAAAATGCCCATTTGAAGAAGAACTTCAAACCTCAAGGTTCC ATTGAGCATTTGCAAAGTGGTGTTTACTACTTGACCAACATCGAT GACAAATTTAGAAGATCTTACGATGTTAAAAAATAAT |
| SEQ ID NO: 29 HMG-CoA synthase (Sc_ERG13, HMGS) *Saccharomyces* sp. | MTELKKQKTAEQKTRPQNVGIKGIQIYIPTQCVNQSELEKFDGVS QGKYTIGLGQTNMSFVNDREDIYSMSLTVLSKLIKSYNIDTNKIG RLEVGTETLIDKSKSVKSVLMQLFGENTDVEGIDTLNACYGGTNA LFNSLNWIESNAWDGRDAIWCGDIAIYDKGAARPTGGAGTVAMWI GPDAPIVFDSVRASYMEHAYDFYKPDFTSEYPYVDGHFSLTCYVK ALDQVYKSYSKKAISKGLVSDPAGSDALNVLKYFDYNVFHVPTCK LVTKSYGRLLYNDFRANPQLFPEVDAELATRDYDESLTDKNIEKT FVNVAKPFHKERVAQSLIVPTNTGNMYTASVYAAFASLLNYVGSD DLQGKRVGLFSYGSGLAASLYSCKIVGDVQHIIKELDITNKLAKR ITETPKDYEAAIELRENAHLKKNFKPQGSIEHLQSGVYYLTNIDD KFRRSYDVKK* |
| SEQ ID NO: 30 Acctoacctyl CoA thiolase (ERG 10) *Saccharomyces cerevisiae* | ATGTCTCAGAACGTTTACATTGTATCGACTGCCAGAACCCCAATT GGTTCATTCCAGGGTTCTCTATCCTCCAAGACAGCAGTGGAATTG GGTGCTGTTGCTTTAAAAGGCGCCTTGGCTAAGGTTCCAGAATTG GATGCATCCAAGGATTTTGACGAAATTATTTTTGGTAACGTTCTT TCTGCCAATTTGGGCCAAGCTCCGGCCAGACAAGTTGCTTTGGCT GCCGGTTTGAGTAATCATATCGTTGCAAGCACAGTTAACAAGGTC TGTGCATCCGCTATGAAGGCAATCATTTTGGGTGCTCAATCCATC AAATGTGGTAATGCTGATGTTGTCGTAGCTGGTGGTTGTGAATCT ATGACTAACGCACCATACTACATGCCAGCAGCCCGTGCGGGTGCC AAATTTGGCCAAACTGTTCTTGTTGATGGTGTCGAAAGAGATGGG |

TABLE 1-continued

| Amino acid and nucleotide sequences of the disclosure | |
|---|---|
| | TTGAACGATGCGTACGATGGTCTAGCCATGGGTGTACACGCAGAA AAGTGTGCCCGTGATTGGGATATTACTAGAGAACAACAAGACAAT TTTGCCATCGAATCCTACCAAAAATCTCAAAAATCTCAAAAGGAA GGTAAATTCGACAATGAAATTGTACCTGTTACCATTAAGGGATTT AGAGGTAAGCCTGATACTCAAGTCACGAAGGACGAGGAACCTGCT AGATTACACGTTGAAAAATTGAGATCTGCAAGGACTGTTTTCCAA AAAGAAAACGGTACTGTTACTGCCGCTAACGCTTCTCCAATCAAC GATGGTGCTGCAGCCGTCATCTTGGTTTCCGAAAAAGTTTTGAAG GAAAAGAATTTGAAGCCTTTGGCTATTATCAAAGGTTGGGGTGAG GCCGCTCATCAACCAGCTGATTTTACATGGGCTCCATCTCTTGCA GTTCCAAAGGCTTTGAAACATGCTGGCATCGAAGACATCAATTCT GTTGATTACTTTGAATTCAATGAAGCCTTTTCGGTTGTCGGTTTG GTGAACACTAAGATTTTGAAGCTAGACCCATCTAAGGTTAATGTA TATGGTGGTGCTGTTGCTCTAGGTCACCCATTGGGTTGTTCTGGT GCTAGAGTGGTTGTTACACTGCTATCCATCTTACAGCAAGAAGGA GGTAAGATCGGTGTTGCCGCCATTTGTAATGGTGGTGGTGGTGCT TCCTCTATTGTCATTGAAAAGATATGA |
| SEQ ID NO: 31<br>Acetoacetyl CoA thiolase (ERG10)<br>*Saccharomyces cerevisiae* | MSQNVYIVSTARTPIGSFQGSLSSKTAVELGAVALKGALAKVPEL DASKDFDEIIFGNVLSANLGQAPARQVALAAGLSNHIVASTVNKV CASAMKAIILGAQSIKCGNADVWAGGCESMTNAPYYMPAARAGAK FGQTVLVDGVERDGLNDAYDGLAMGVHAEKCARDWDITREQQDNF AIESYQKSQKSQKEGKFDNEIVPVTIKGFRGKPDTQVTKDEEPAR LHVEKLRSARTVFQKENGTVTAANASPINDGAAAVILVSEKVLKE KNLKPLAIIKGWGEAAHQPADFTWAPSLAVPKALKHAGIEDINSV DYFEFNEAFSWGLVNTKILKLDPSKVNVYGGAVALGHPLGCSGAR WVTLLSILQQEGGKIGVAAICNGGGGASSIVIEKI* |
| SEQ ID NO: 32<br>Mevalonate pyrophosphate decarboxylase (Sc_ERG19, MVD1)<br>*Saccharomyces* sp. | ATGACCGTTTACACAGCATCCGTTACCGCACCCGTCAACATCGCA ACCCTTAAGTATTGGGGGAAAAGGGACACGAAGTTGAATCTGCCC ACCAATTCGTCCATATCAGTGACTTTATCGCAAGATGACCTCAGA ACGTTGACCTCTGCGGCTACTGCACCTGAGTTTGAACGCGACACT TTGTGGTTAAATGGAGAACCACACAGCATCGACAATGAAAGAACT CAAAATTGTCTGCGCGACCTACGCCAATTAAGAAAGGAAATGGAA TCGAAGGACGCCTCATTGCCCACATTATCTCAATGGAAACTCCAC ATTGTCTCCGAAAATAACTTTCCTACAGCAGCTGGTTTAGCTTCC TCCGCTGCTGGCTTTGCTGCATTGGTCTCTGCAATTGCTAAGTTA TACCAATTACCACAGTCAACTTCAGAAATATCTAGAATAGCAAGA AAGGGGTCTGGTTCAGCTTGTAGATCGTTGTTTGGCGGATACGTG GCCTGGGAAATGGGAAAAGCTGAAGATGGTCATGATTCCATGGCA GTACAAATCGCAGACAGCTCTGACTGGCCTCAGATGAAAGCTTGT GTCCTAGTTGTCAGCGATATTAAAAAGGATGTGAGTTCCACTCAG GGTATGCAATTGACCGTGGCAACCTCCGAACTATTTAAAGAAAGA ATTGAACATGTCGTACCAAAGAGATTTGAAGTCATGCGTAAAGCC ATTGTTGAAAAAGATTTCGCCACCTTTGCAAAGGAAACAATGATG GATTCCAACTCTTTCCATGCCACATGTTTGGACTCTTTCCCTCCA ATATTCTACATGAATGACACTTCCAAGCGTATCATCAGTTGGTGC CACACCATTAATCAGTTTTACGGAGAAACAATCGTTGCATACACG TTTGATGCAGGTCCAAATGCTGTGTTGTACTACTTAGCTGAAAAT GAGTCGAAACTCTTTGCATTTATCTATAAATTGTTTGGCTCTGTT CCTGGATGGGACAAGAAATTTACTACTGAGCAGCTTGAGGCTTTC AACCATCAATTTGAATCATCTAACTTTACTGCACGTGAATTGGAT CTTGAGTTGCAAAAGGATGTTGCCAGAGTGATTTTAACTCAAGTC GGTTCAGGCCCACAAGAAACAAACGAATCTTTGATTGACGCAAAG ACTGGTCTACCAAAGGAATAA |
| SEQ ID NO: 33<br>Mevalonate pyrophosphate decarboxylase (Sc_ERG19, MVD1)<br>*Saccharomyces* sp. | MTVYTASVTAPVNIATLKYWGKRDTKLNLPTNSSISVTLSQDDLR TLTSAATAPEFERDTLWLNGEPHSIDNERTQNCLRDLRQLRKEME SKDASLPTLSQWKLHIVSENNFPTAAGLASSAAGFAALVSAIAKL YQLPQSTSEISRIARKGSGSACRSLFGGYVAWEMGKAEDGHDSMA VQIADSSDWPQMKACVLWSDIKKDVSSTQGMQLTVATSELFKERI EHVWKRFEVMRKAIVEKDFATFAKETMMDSNSFHATCLDSFPPIF YMNDTSKRIISWCHTINQFYGETIVAYTFDAGPNAVLYYLAENES KLFAFIYKLFGSVPGWDKKFTTEQLEAFNHQFESSNFTARELDLE LQKDVARVILTQVGSGPQETNESLIDAKTGLPKE* |
| SEQ ID NO: 34<br>Pyruvate decarboxy lase (Zm_PDC)<br>Artificial sequence<br>Codon optimized | ATGTCCTACACCGTTGGTACCTACTTAGCTGAGCGTTTGGTCCAA ATCGGTTTGAAGCACCATTTCGCCGTTGCTGGTGATTACAACTTG GTCTTGTTAGATAATTTATTATTGAACAAGAACATGGAACAAGTC TACTGCTGTAATGAATTGAACTGTGGTTTCTCTGCTGAAGGTTAT GCTAGAGCTAAAGGTGCCGCTGCCGCTGTTGTCACTTACTCTGTT GGTGCTTTGTCTGCCTTCGACGCTATTGGTGGTGCTTACGCCGAG AATTTACCTGTTATTTTAATTTCTGGTGCCCCTAACAATAACGAT CATGCTGCTGGTCATGTTTTACACCACGCTTTGGGTAAAACTGAC TACCATTATCAATTAGAGATGGCCAAAAACATCACCGCCGCTGCC GAGGCCATTTACACTCCAGAAGAAGCCCCAGCCAAAATTGATCAC GTCATCAAAACCGCCTTGAGAGAGAAAAAACCTGTTTACTTGGAA ATCGCCTGTAATATCGCCTCTATGCCTTGCGCCGCTCCTGGTCCT |

TABLE 1-continued

| Amino acid and nucleotide sequences of the disclosure | |
|---|---|
| | GCTTCCGCCTTATTCAACGATGA<br>GGCTTCTGATGAAGCTTCCTTAAACGCTGCTGTTGAGGAGACTTT<br>AAAGTTCATCGCTAATAGAGATAAGGTCGCTGTTTTAGTCGGTTC<br>TAAGTTGCGTGCTGCCGGTGCCGAGGAAGCTGCTGTTAAATTCGC<br>CGATGCTTTAGGTGGTGCTGTCGCCACCATGGCCGCCGCCAAATC<br>CTTTTTCCCTGAAGAAAACCCACACTACATCGGTACTTCTTGGGG<br>TGAAGTCTCTTACCCAGGTGTCGAAAAGACTATGAAGGAAGCCGA<br>TGCCGTCATCGCCTTGGCCCCAGTTTTTAATGATTATTCCACCAC<br>TGGTTGGACTGATATCCCAGATCCTAAAAAGTTAGTTTTAGCCGA<br>GCCTAGATCCGTTGTTGTTAACGGTATTAGATTCCCTTCCGTTCA<br>CTTGAAGGATTACTTAACTAGATTGGCTCAAAAGGTTTCCAAGAA<br>GACCGGTGCTTTGGACTTTTTCAAATCTTTGAACGCCGGTGAGTT<br>AAAGAAGGCCGCCCCTGCTGACCCATCTGCTCCATTGGTTAACGC<br>TGAGATTGCTAGACAAGTCGAAGCTTTATTGACCCCAAACACTAC<br>CGTTATCGCCGAAACTGGTGACTCTTGGTTTAATGCTCAAAGAAT<br>GAAGTTACCAAATGGTGCCAGAGTTGAGTACGAAATGCAATGGGG<br>TCATATCGGTTGGTCTGTCCCAGCTGCTTTTGGTTATGCTGTTGG<br>TGCCCCTGAGAGAAGAAACATCTTGATGGTTGGTGACGGTTCCTT<br>CCAATTGACTGCTCAAGAAGTCGCTCAAATGGTTAGATTAAAATT<br>ACCAGTCATCATCTTCTTGATCAATAACTACGGTTACACTATCGA<br>AGTCATGATTCACGATGGTCCTTACAATAATATTAAGAACTGGGA<br>CTATGCTGGTTTGATGGAAGTCTTTAATGGTAACGGTGGTTACGA<br>TTCCGGTGCTGGTAAGGGTTTAAAGGCTAAGACTGGTGGTGAATT<br>AGCTGAAGCCATTAAGGTTGCCTTGGCTAACACCGACGGTCCTAC<br>TTTAATCGAATGTTTCATTGGTAGAGAGGATTGTACCGAAGAGTT<br>AGTTAAGTGGGGTAAGAGAGTTGCCGCTGCTAATTCCCGTAAGCC<br>TGTCAATAAATTGTTATAA |
| SEQ ID NO: 35<br>Pyruvate<br>decarboxylase<br>(ZmPDC)<br>*Zymomonas mobilis* | MSYTVGTYLAERLVQIGLKHHFAVAGDYNLVLLDNLLLNKNMEQV<br>YCCNELNCGFSAEGYARAKGAAAAVVTYSVGAJLSAFDAIGGAYA<br>ENLPVILISGAPNNNDHAAGHVLHHALGKTDYHYQLEMAKNITAA<br>AEAIYTPEEAPAKIDHVIKTALREKKPVYLEIACNIASMPCAAPG<br>PASALFNDEASDEASLNAAVEETLKFIANRDKVAVLVGSKLRAAG<br>AEEAAVKFADALGGAVATMAAAKSFFPEENPHYIGTSWGEVSYPG<br>VEKTMKEADAVIALAPVFNDYSTTGWTDIPDPKKLVLAEPRSVWN<br>GIRFPSVHLKDYLTRLAQKVSKKTGALDFFKSLNAGELKKAAPAD<br>PSAPLVNAEIARQVEALLTPNTTVIAETGDSWFNAQRMKLPNGAR<br>VEYEMQWGHIGWSVPAAFGYAVGAPERRNILMVGDGSFQLTAQEV<br>AQMVRLKLPVIIFLINNYGYTIEVMIHDGPYNNIKNWDYAGLMEV<br>FNGNGGYDSGAGKGLKAKTGGELAEAIKVALANTDGPTLIECFIG<br>REDCTEELVKWGKRVAAANSRKPVNKLL* |
| SEQ ID NO: 36<br>Phosphomevalonate<br>kinase<br>(Sc_ERG8, PMK)<br>*Saccharomyces*<br>*cerevisiae* | ATGTCAGAGTTGAGAGCCTTCAGTGCCCCAGGGAAAGCGTTACTA<br>GCTGGTGGATATTTAGTTTTAGATCCGAAATATGAAGCATTTGTA<br>GTCGGATTATCGGCAAGAATGCATGCTGTAGCCCATCCTTACGGT<br>TCATTGCAAGAGTCTGATAAGTTTGAAGTGCGTGTGAAAAGTAAA<br>CAATTTAAAGATGGGGAGTGGCTGTACCATATAAGTCCTAAAACT<br>GGCTTCATTCCTGTTTCGATAGGCGGATCTAAGAACCCTTTCATT<br>GAAAAAGTTATCGCTAACGTATTTAGCTACTTTAAGCCTAACATG<br>GACGACTACTGCAATAGAAACTTGTTCGTTATTGATATTTTCTCT<br>GATGATGCCTACCATTCTCAGGAGGACAGCGTTACCGAACATCGT<br>GGCAACAGAAGATTGAGTTTTCATTCGCACAGAATTGAAGAAGTT<br>CCCAAAACAGGGCTGGGCTCCTCGGCAGGTTTAGTCACAGTTTTA<br>ACTACAGCTTTGGTTATTCATAATTTATCACAAGTTGCTCATTGT<br>CAAGCTCAGGGTAAAATTGGAAGCGGGTTTGATGTAGCGGCGGCA<br>GCATATGGATCTATCAGATATAGAAGATTCCCACCCGCATTAATC<br>TCTAATTTGCCAGATATTGGAAGTGCTACTTACGGCAGTAAACTG<br>GCGCATTTGGTTAATGAAGAAGACTGGAATATAACGATTAAAAGT<br>AACCATTTACCTTCGGGATTAACTTTATGGATGGGCGATATTAAG<br>AATGGTTCAGAAACAGTAAAACTGGTCCAGAAGGTAAAAAATTGG<br>TATGATTCGCATATGCCGGAAAGCTTGAAAATATATACAGAACTC<br>GATCATGCAAATTCTAGATTTATGGATGGACTATCTAAACTAGAT<br>CGCTTACACGAGACTCATGACGATTACAGCGATCAGATATTTGAG<br>TCTCTTGAGAGGAATGACTGTACCTGTCAAAAGTATCCTGAGATC<br>ACAGAAGTTAGAGATGCAGTTGCCACAATTAGACGTTCCTTTAGA<br>AAAATAACTAAAGAATCTGGTGCCGATATCGAACCTCCCGTACAA<br>ACTAGCTTATTGGATGATTGCCAGACCTTAAAAGGAGTTCTTACT<br>TGCTTAATACCTGGTGCTGGTGGTTATGACGCCATTGCAGTGATT<br>GCTAAGCAAGATGTTGATCTTAGGGCTCAAACCGCTGATGACAAA<br>AGATTTTCTAAGGTTCAATGGCTGGATGTAACTCAGGCTGACTGG<br>GGTGTTAGGAAAGAAAAAGATCCGGAAACTTATCTTGATAAATAA |
| SEQ ID NO: 37<br>Phosphomevalonate<br>kinase<br>(Sc_ERG8, PMK)<br>*Saccharomyces*<br>*cerevisiae* | MSELRAFSAPGKALLAGGYLVLDPKYEAFVVGLSARMHAVAHPYG<br>SLQESDKFEVRVKSKQFKDGEWLYHISPKTGFIPVSIGGSKNPFI<br>EKVIANVFSYFKPNMDDYCNRNLFVIDIFSDDAYHSQEDSVTEHR<br>GNRRLSFHSHRIEEVPKTGLGSSAGLVTVLTTALASFFVSDLENN<br>VDKYREVIHNLSQVAHCQAQGKIGSGFDVAAAAYGSIRYRRFPPA<br>LISNLPDIGSATYGSKLAHLVNEEDWNITIKSNHLPSGLTLWMGD |

TABLE 1-continued

| Amino acid and nucleotide sequences of the disclosure | |
|---|---|
| | IKNGSETVKLVQKVKNWYDSHMPESLKIYTELDHANSRFMDGLSK<br>LDRLHETHDDYSDQIFESLERNDCTCQKYPEITEVRDAVATIRRS<br>FRKITKESGADIEPPVQTSLLDDCQTLKGVLTCLIPGAGGYDAIA<br>VIAKQDVDLRAQTADDKRFSKVQWLDVTQADWGVRKEKDPETYLD<br>K* |
| SEQ ID NO: 38<br>Mevalonate kinase<br>(ERG12, MK)<br>*Saccharomyces* sp. | ATGTCATTACCGTTCTTAACTTCTGCACCGGGAAAGGTTATTATT<br>TTTGGTGAACACTCTGCTGTGTACAACAAGCCTGCCGTCGCTGCT<br>AGTGTGTCTGCGTTGAGAACCTACCTGCTAATAAGCGAGTCATCT<br>GCACCAGATACTATTGAATTGGACTTCCCGGACATTAGCTTTAAT<br>CATAAGTGGTCCATCAATGATTTCAATGCCATCACCGAGGATCAA<br>GTAAACTCCCAAAAATTGGCCAAGGCTCAACAAGCCACCGATGGC<br>TTGTCTCAGGAACTCGTTAGTCTTTTGGATCCGTTGTTAGCTCAA<br>CTATCCGAATCCTTCCACTACCATGCAGCGTTTTGTTTCCTGTAT<br>ATGTTTGTTTGCCTATGCCCCCATGCCAAGAATATTAAGTTTTCT<br>TTAAAGTCTACTTTACCCATCGGTGCTGGGTTGGGCTCAAGCGCC<br>TCTATTTCTGTATCACTGGCCTTAGCTATGGCCTACTTGGGGGGG<br>TTAATAGGATCTAATGACTTGGAAAAGCTGTCAGAAAACGATAAG<br>CATATAGTGAATCAATGGGCCTTCATAGGTGAAAAGTGTATTCAC<br>GGTACCCCTTCAGGAATAGATAACGCTGTGGCCACTTATGGTAAT<br>GCCCTGCTATTTGAAAAAGACTCACATAATGGAACAATAAACACA<br>AACAATTTTAAGTTCTTAGATGATTTCCCAGCCATTCCAATGATC<br>CTAACCTATACTAGAATTCCAAGGTCTACAAAAGATCTTGTTGCT<br>CGCGTTCGTGTGTTGGTCACCGAGAAATTTCCTGAAGTTATGAAG<br>CCAATTCTAGATGCCATGGGTGAATGTGCCCTACAAGGCTTAGAG<br>ATCATGACTAAGTTAAGTAAATGTAAAGGCACCGATGACGAGGCT<br>GTAGAAACTAATAATGAACTGTATGAACAACTATTGGAATTGATA<br>AGAATAAATCATGGACTGCTTGTCTCAATCGGTGTTTCTCATCCT<br>GGATTAGAACTTATTAAAAATCTGAGCGATGATTTGAGAATTGGC<br>TCCACAAAACTTACCGGTGCTGGTGGCGGCGGTTGCTCTTTGACT<br>TTGTTACGAAGAGACATTACTCAAGAGCAAATTGACAGTTTCAAA<br>AAGAAATTGCAAGATGATTTTAGTTACGAGACATTTGAAACAGAC<br>TTGGGTGGGACTGGCTGCTGTTTGTTAAGCGCAAAAAATTTGAAT<br>AAAGATCTTAAAATCAAATCCCTAGTATTCCAATTATTTGAAAAT<br>AAAACTACCACAAAGCAACAAATTGACGATCTATTATTGCCAGGA<br>AACACGAATTTACCATGGACTTCATAA |
| SEQ ID NO: 39<br>Mevalonate kinase<br>(ERG12, MK)<br>*Saccharomyces* sp. | MSLPFLTSAPGKVIIFGEHSAVYNKPAVAASVSALRTYLLISESS<br>APDTIELDFPDISFNHKWSINDFNAITEDQVNSQKLAKAQQATDG<br>LSQELVSLLDPLLAQLSESFHYHAAFCFLYMFVCLCPHAKNIKFS<br>LKSTLPIGAGLGSSASISVSLALAMAYLGGLIGSNDLEKLSENDK<br>HIVNQWAFIGEKCIHGTPSGIDNAVATYGNALLFEKDSHNGTINT<br>NNFKFLDDFPAIPMILTYTRIPRSTKDLVARVRVLVTEKFPEVMK<br>PILDAMGECALQGLEIMTKLSKCKGTDDEAVETNNELYEQLLELI<br>RINHGLLVSIGVSHPGLELIKNLSDDLRIGSTKLTGAGGGGCSLT<br>LLRRDITQEQIDSFKKKLQDDFSYETFETDLGGTGCCLLSAKNLN<br>KDLKIKSLVFQLFENKTTTKQQIDDLLLPGNTNLPWTS* |
| SEQ ID NO: 40<br>Variant farnesyl<br>pyrophosphate synthase<br>(ERG20mut, F96W,<br>N127W; GPPS)<br>Artificial sequence<br>Codon optimized | ATGGCTTCTGAGAAGGAGATTCGTCGTGAGAGATTCTTGAATGTT<br>TTTCCTAAATTAGTCGAGGAATTGAACGCTTCTTTGTTGGCTTAT<br>GGTATGCCTAAGGAAGCTTGTGATTGGTATGCTCACTCCTTGAAT<br>TATAATACTCCAGGTGGTAAATTGAACCGTGGTTTGTCTGTTGTT<br>GACACTTACGCTATTTTATCTAACAAGACCGTCGAGCAATTGGGT<br>CAAGAAGAGTATGAAAAGGTCGCTATTTTAGGTTGGTGTATTGAA<br>TTGTTGCAAGCTTACTGGTTGGTTGCCGATGACATGATGGACAAG<br>TCTATTACTCGTCGTGGTCAACCTTGCTGGTATAAGGTCCCAGAG<br>GTTGGTGAAATTGCTATCTGGGACGCTTTCATGTTGGAAGCTGCT<br>ATCTATAAATTGTTGAAATCCCACTTCAGAAACGAGAAATACTAC<br>ATTGACATCACCGAGTTGTTCCACGAAGTCACTTTCCAAACTGAG<br>TTAGGTCAATTAATGGACTTGATCACCGCTCCAGAAGACAAAGTT<br>GACTTGTCCAAGTTTTCCTTGAAAAAGCACTCTTTCATCGTTACT<br>TTCAAGACTGCTTATTACTCTTTCTACTTACCAGTTGCCTTGGCT<br>ATGTACGTCGCCGGTATCACTGACGAAAAGGACTTGAAGCAAGCT<br>CGTGACGTTTTGATTCCATTAGGTGAATATTTCCAAATCCAAGAT<br>GACTACTTAGACTGTTTTGGTACCCCTGAACAAATCGGTAAGATC<br>GGTACTGATATTCAAGATAACAAGTGCTCTTGGGTTATCAACAAG<br>GCTTTAGAGTTAGCCTCCGCCGAACAACGTAAAACTTTAGATGAA<br>AACTACGGTAAAAAAGACTCTGTTGCTGAGGCCAAGTGTAAGAAG<br>ATTTTTAACGATTTAAAAATCGAACAATTGTATCACGAATATGAA<br>GAGTCCATTGCTAAGGATTTGAAGGCTAAAATTTCTCAAGTTGAC<br>GAATCCCGTGGTTTCAAAGCTGACGTTTTG |
| SEQ ID NO: 41<br>Variant farnesyl<br>pyrophosphate synthase<br>(ERG20mut, F96W,<br>N127W; GPPS)<br>Artificial sequence | MASEKEIRRERFLNVFPKLVEELNASLLAYGMPKEACDWYAHSLN<br>YNTPGGKLNRGLSWDTYAILSNKTVEQLGQEEYEKVAILGWCIEL<br>LQAYWLVADDMMDKSITRRGQPCWYKVPEVGEIAIWDAFMLEAAI<br>YKLLKSHFRNEKYYIDITELFHEVTFQTELGQLMDLITAPEDKVD<br>LSKFSLKKHSFIVTFKTAYYSFYLPVALAMYVAGITDEKDLKQAR<br>DVLIPLGEYFQIQDDYLDCFGTPEQIGKIGTDIQDNKCSWVINKA |

TABLE 1-continued

| Amino acid and nucleotide sequences of the disclosure | |
|---|---|
| | LELASAEQRKTLDENYGKKDSVAEAKCKKIFNDLKIEQLYHEYEE<br>SIAKDLKAKISQVDESRGFKADVLTAFLNKVYKRSK* |
| SEQ ID NO: 42<br>GFP<br>Artificial sequence | ATGTCTACCGCACTAACAGAAGGAGCTAAACTATTCGAAAAGGAG<br>ATTCCTTACATTACAGAATTAGAGGGTGATGTCGAAGGAATGAAA<br>TTCATTATCAAGGGCGAGGGTACTGGTGACGCTACTACCGGTACG<br>ATTAAAGCAAAGTACATCTGTACAACAGGTGACCTTCCTGTTCCG<br>TGGGCTACTCTGGTGAGCACTTTGTCTTATGGAGTTCAATGTTTT<br>GCTAAATACCCTTCGCACATTAAAGACTTTTTCAAAAGTGCAATG<br>CCTGAGGGCTATACTCAGGAGAGAACAATATCTTTCGAAGGAGAT<br>GGTGTGTATAAGACTAGGGCTATGGTCACGTATGAAAGAGGATCC<br>ATCTACAATAGAGTAACTTTAACTGGTGAAAACTTCAAAAAGGAC<br>GGTCACATCCTTAGAAAGAATGTTGCCTTTCAATGCCCACCATCC<br>ATCTTGTACATTTTGCCAGACACAGTTAACAATGGTATCAGAGTT<br>GAGTTTAACCAAGCTTATGACATAGAGGGTGTCACCGAAAAGTTG<br>GTTACAAAATGTTCACAGATGAATCGTCCCCTGGCAGGATCAGCT<br>GCCGTCCATATCCCACGTTACCATCATATCACTTATCATACCAAG<br>CTGTCCAAAGATCGTGATGAGAGAAGGGATCACATGTGTTTGGTT<br>GAAGTGGTAAAGGCCGTGGATTTGGATACTTACCAAGGTTGA |
| SEQ ID NO: 43<br>GFP<br>Artificial sequence | MSTALTEGAKLFEKEIPYITELEGDVEGMKFIIKGEGTGDATTGT<br>IKAKYICTTGDLPVPWATLVSTLSYGVQCFAKYPSHIKDFFKSAM<br>PEGYTQERTISFEGDGVYKTRAMVTYERGSIYNRVTLTGENFKKD<br>GHILRKNVAFQCPPSILYILPDTVNNGIRVEFNQAYDIEGVTEKL<br>VTKCSQMNRPLAGSAAVHIPRYHHITYHTKLSKDRDERRDHMCLV<br>EVVKAVDLDTYQG* |
| SEQ ID NO: 44<br>THCA synthase<br>*Cannabis sativa* | MNCSAFSFWFVCKIIFFFLSFHIQISIANPRENFLKCFSKHIPNN<br>VANPKLVYTQHDQLYMSILNSTIQNLRFISDTTPKPLVIVTPSNN<br>SHIQATILCSKKVGLQIRTRSGGHDAEGMSYISQVPFVWDLRNMH<br>SIKIDVHSQTAWVEAGATLGEVYYWINEKNENLSFPGGYCPTVGV<br>GGHFSGGGYGALMRNYGLAADNIIDAHLVNVDGKVLDRKSMGEDL<br>FWAIRGGGGENFGIIAAWKIKLVAVPSKSTIFSVKKNMEIHGLVK<br>LFNKWQNIAYKYDKDLVLMTHFITKNITDNHGKNKTTVHGYFSSI<br>FHGGVDSLVDLMNKSFPELGIKKTDCKEFSWIDTTIFYSGWNFNT<br>ANFKKEILLDRSAGKKTAFSIKLDYVKKPIPETAMVKILEKLYEE<br>DVGAGMYVLYPYGGIMEEISESAIPFPHRAGIMYELWYTASWEKQ<br>EDNEKHINWVRSVYNFTTPYVSQNPRLAYLNYRDLDLGKTNHASP<br>NNYTQARIWGEKYFGKNFNRLVKVKTKVDPNNFFRNEQSIPPLPP<br>HHH* |
| SEQ ID NO: 45<br>THCA synthase<br>Artificial sequence<br>Codon optimized<br>sequence 1 | ATGAATTGTTCTGCTTTCTCTTTCTGGTTCGTTTGTAAGATCATC<br>TTTTTCTTCTTATCTTTCCATATTCAAATCTCTATCGCTAACCCT<br>CGTGAGAACTTCTTGAAATGTTTCTCCAAACATATCCCAAACAAT<br>GTCGCTAACCCTAAGTTAGTTTACACTCAACATGATCAATTATAT<br>ATGTCTATCTTGAACTCTACCATCCAAAACTTGAGATTCATCTCC<br>GATACCACCCCAAAACCATTGGTTATTGTTACCCCATCCAACAAT<br>TCTCATATTCAAGCTACCATTTTGTGCTCCAAAAAGGTCGGTTTG<br>CAAATCCGTACTAGATCTGGTGGTCACGATGCTGAAGGTATGTCT<br>TACATTTCCCAAGTCCCATTCGTTGTTGTCGATTTAAGAAATATG<br>CACTCTATCAAAATCGACGTTCACTCTCAAACTGCTTGGGTTGAA<br>GCCGGTGCCACTTTAGGTGAGGTTTACTACTGGATTAACGAAAAG<br>AATGAAAACTTATCCTTTCCAGGTGGTTACTGTCCAACTGTTGGT<br>GTTGGTGGTCACTTCTCTGGTGGTGGTTATGGTGCCTTGATGAGA<br>AACTACGGTTTAGCTGCTGATAATATTATCGACGCTCACTTGGTT<br>AATGTCGACGGTAAGGTTTTGGACAGAAAATCCATGGGTGAAGAT<br>TTATTCTGGGCCATTAGAGGTGGTGGTGGTGAAAACTTCGGTATC<br>ATTGCTGCTTGGAAAATTAAATTGGTCGCTGTCCCATCCAAGTCT<br>ACTATTTTCTCCGTCAAGAAAAACATGGAAATTCATGGTTTGGTT<br>AAATTATTCAACAAGTGGCAAAACATTGCTTACAAATACGACAAA<br>GACTTAGTTTTGATGACCCACTTCATTACTAAAAACATTACCGAC<br>AACCATGGTAAAAATAAAACTACTGTTCACGGTTACTTCTCTTCC<br>ATTTTTCATGGTGGTGTCGACTCCTTGGTCGATTTAATGAACAAA<br>TCTTTCCCTGAGTTGGGTATCAAGAAGACCGACTGTAAAGAATTC<br>TCTTGGATCGACACTACTATTTTCTACTCTGGTGTCGTTAACTTC<br>AACACCGCTAATTTCAAGAAGGAAATTTTATTAGATAGATCCGCT<br>GGTAAAAAGACCGCTTTCTCTATCAAATTAGACTACGTTAAAAAA<br>CCAATCCCAGAAACCGCTATGGTCAAAATCTTGGAAAAATTATAT<br>GAAGAAGACGTTGGTGCCGGTATGTACGTCTTATATCCATATGGT<br>GGTATTATGGAAGAGATCTCTGAATCCGCTATCCCTTTTCCACAC<br>AGAGCCGGTATTATGTACGAATTATGGTACACTGCTTCCTGGGAG<br>AAACAAGAAGATAATGAAAAGCACATTAACTGGGTTAGATCTGTT<br>TACAACTTCACTACTCCATACGTCTCTCAAAACCCAAGATTAGCC<br>TACTTAAACTACCGTGATTTGGATTTAGGTAAAACTAATCACGCT<br>TCCCCAAACAACTACACCCAAGCTAGAATTTGGGGTGAGAAGTAC<br>TTTGGTAAGAACTTCAACCGTTTAGTCAAGGTCAAGACTAAAGTT<br>GATCCAAACAATTTTTTCAGAAACGAACAATCTATCCCACCTTTA<br>CCACCACACCACCATTAG |

TABLE 1-continued

| Amino acid and nucleotide sequences of the disclosure | |
|---|---|
| SEQ ID NO: 46<br>pGAL1_tTDH1<br>*Saccharomyces* sp. | TGTTGTGGAAATGTAAAGAGCCCCATTATCTTAGCCTAAAAAAAC<br>CTTCTCTTTGGAACTTTCAGTAATACGCTTAACTGCTCATTGCTA<br>TATTGAAGTACGGATTAGAAGCCGCCGAGCGGGCGACAGCCCTCC<br>GACGGAAGACTCTCCTCCGTGCGTCCTGGTCTTCACCGGTCGCGT<br>TCCTGAAACGCAGATGTGCCTCGCGCCGCACTGCTCCGAACAATA<br>AAGATTCTACAATACTAGCTTTTATGGTTATGAAGAGGAAAAATT<br>GGCAGTAACCTGGCCCCACAAACCTTCAAATCAAATTTCTGGGGT<br>AATTAATCAGCGAAGCGATGATTTTTGATCTATTAACAGATAT<br>ATAAATGCAAAAGCTGCATAACCACTTTAACT<br>AATACTTTCAACATTTTCGGTTTGTATTACTTCTTATTCA<br>AATGTCATAAAAGTATCAACAAAAAATTGTTAATATACCTCT<br>ATACTTTAACGTCAAGGAGAAAAAACTATAC<br>TCTTATTACCCTATCCTATGGATAAAGCAATCTTGATGAGGATA<br>ATGATTTTTTTTTGAATATACATAAATACTACCGTTTTTCTGCTA<br>GATTTTGTGAAGACGTAAATAAGTACATATTACTTTTTAAGCCAA<br>GACAAGATTAAGCATTAACTTTACCCTTTTCTCTTCTAAGTTT<br>CAATACTAGTTATCACTGTTTAAAAGTTATGGCGA<br>GAACGTCGGCGGTTAAAATATATTACCCTGAACGTGGTGAATTGA<br>AGTTCTAGGATGGTTTAAAGATTTTTCCTTTTTGGGA<br>AATAAGTAAACAATATATTGCTGCCTTTGC |
| SEQ ID NO: 47<br>OAC Y27F variant<br>(OAC*)<br>Artificial sequence<br>Codon optimized | ATGGCCGTCAAACACTTGATCGTCTTAAAATTCAAGGATGAAATT<br>ACTGAAGCTCAAAAAGAAGAGTTCTTCAAAA<br>CCTTCGTCAATTTAGTCAACATTATTCCTGCTATG<br>AAGGACGTTTACTGGGGTAAGGATGTCACCCAAAAGAACAAGGAA<br>GAAGGTTACACTCACATTGTTGAAGTCACTTTCGAATCTGTTGAA<br>ACTATCCAAGATTATATTATCCACCCAGCTCATGTCGGTTTTGGT<br>GATGTTTACAGATCTTTTTGGGAAAAATTGTTGATCTTTGACTAT<br>ACTCCAAGAAAATAA |
| SEQ ID NO: 48<br>OAC Y27F variant<br>(OAC*)<br>Artificial sequence | MAVKHLIVLKFKDEITEAQKEEFFKTFVNLVNIIPAMKDVYWGKD<br>VTQKNKEEGYTHIVEVTFESVETIQDYIIHPAHVGFGDVYRSFWE<br>KLLIFDYTPRK* |
| SEQ ID NO: 49<br>CBDA Synthase, C12F<br>variant<br>Artificial sequence<br>Codon optimized | ATGAAATGCTCCACTTTCTCTTTCTGGTTCGTTtttAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAA<br>ATATGCGTTCCATCAAGATTGATGTCCATTCCCAAACTGCTT<br>GGGTTGAAGCCGGTGCCACTTTAGGTGAAGTCTATTACTGGGTTA<br>ACGAGAAGAATGAGAACTTATCTTTGGCTGCCGGTTACTGTCCAA<br>CTGTTTGTGCTGGTGGTCATTTCGGTGGTGGTGGTTACGGTCCAT<br>TAATGCGTAACTACGGTTTGGCTGCCGATAACATCATTGATGCC<br>CACTTAGTCAACGTTCATGGTAAGGTCTTGGACCGTAAGTCTATG<br>GGTGAGGATTTATTCTGGGCTTTGAGAGGTGGTGGTGCTGAATC<br>TTTCGGTATTATCGTCGCTTGGAAGATTAGATTAGTTGCTGTT<br>CCAAAGTCTACTATGTTCTCTGTTAAGAAGATCATGGAAATTCAC<br>GAGTTGGTTAAATTAGTTAACAAATGGC<br>AAAACATTGCCTACAAGTACGATAAAGATTTGTTATTAATGACTC<br>ACTTTATCACTAGAAACATTACTGATAACCAAGGTAAGAATAAGA<br>CTGCCATTCACACTTACTTCTCTTCTGTTTTCTTGGGTGGTGTTG<br>ATTCCTTGGTCGATTTGATGAACAAGTCTTTTCCAGAATTAGGTA<br>TTAAGAAGACCGATTGTCGTCAATTGATAATTTTAATAAG<br>GAGATTTTGTTAGATAGATCTGCTGGTCAAAAT<br>GGTGCCTTTAAAATCAAATTGGACTACGTTAAGAAGCCTATTCCA<br>GAATCCGTCTTTGTTCAAATTTTGGAGAAGTTATACGAAGAAGAT<br>ATTGGTGCTGGTATGTACGCCTTGTATCCATATGGTGGTATTATG<br>GATGAAATTTCTGAATCCGCCATCCCTTTCCCTCATCGTGCTGGT<br>ATCTTATACGAGTTGTGGTACATCTGTTCTTGGGAAAAGCAAGAA<br>GATAATGAAAAGCATTTGAACTGGATCCGTAACATCTATAAC<br>TTCATGACTCCATACGTTTCCAAAAACCCTAG<br>ATTGGCTTACTTAAATTACAGAGACTTAGATATTG<br>GTATTAACGACCCTAAGAACCCAAACAATTACAC<br>TCAAGCTAGAATCTGGGGTGAAAAGTACTTCGGTAAGAATTTCGA<br>CAGATTAGTTAAGGTCAAGACTTTAGTTGACCCAAATAACTTCTT<br>CAGAAACGAACAATCTATCCCACCATTGCCTAGACATAGACACTA<br>G |
| SEQ ID NO: 50<br>CBDA Synthase, C12F<br>variant | MKCSTFSFWFVFKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM |

TABLE 1-continued

| Amino acid and nucleotide sequences of the disclosure | |
|---|---|
| Artificial sequence | RSIKIDVHSQTAWVEAGATLGEVYYWVNEKNENLSLAAGYCPTVC AGGHFGGGGYGPLMRNYGLAADNIIDAHLVNVHGKVLDRKSMGED LFWALRGGGAESFGIIVAWKIRLVAVPKSTMFSVKKIMEIHELVK LVNKWQNIAYKYDKDLLLMTHFITRNITDNQGKNKTAIHTYF SSVFLGGVDSLVDLMNKSFPELGIKKTDCRQLSWIDTIIFYSGW NYDTDNFNKEILLDRSAGQNGAFKIKLDYVKKPIPESVFVQILEK LYEEDIGAGMYALYPYGGIMDEISESAIPFPHRAGILYELWYICS WEKQEDNEKHLNWIRNIYNFMTPYVSKNPRLAYLNYRDLDIGIN DPKNPNNYTQARIWGEKYFGKNFDRLVKVKTLVDPNNFF RNEQSIPPLPRHRH* |
| SEQ ID NO: 51 CBDA Synthase, F17M variant Artificial Sequence Codon optimized | ATGAAATGCTCCACTTTCTCTTTCTGGTTCGTTTGTAAGATTATC TTCatgTTCTTTTCTTTCAACATCCAAACTTCCATTGCCAACCCT CGTGAGAACTTCTTGAAATGTTTTTCTCAATATATCCCA AATAACGCTACTAACTTGAAGTTAGTCTATACTCA AAACAACCCATTATATATGTCTGTCTTAAACTCTACCATTCACAA CTTACGTTTCACTTCTGATACTACTCCAAAACCTTTGGTCATCGT CACCCCATCCCACGTTTCTCACATCCAAGGTACCATCTTGTGTTC CAAAAAGGTTGGTTTACAAATCCGTACTAGATCCGGTGGTCATGA CTCCGAAGGTATGTCTTACATTTCCCAAGTCCCTTTCGTCATCGT CGACTTAAGAAATATGCGTTCCATCAAGATTGATGTCCATTCCCA AACTGCTTGGGTTGAAGCCGGTGCCACTTTAGGTGAAGTCTATTA CTGGGTTAACGAGAAGAATGAGAACTTATCTTTGGCTGCCGGTTA CTGTCCAACTGTTTGTGCTGGTGGTCATTTCGGTGGTGGTGGTTA CGGTCCATTAATGCGTAACTACGGTTTGGCTGCCGATAACATCAT TGATGCCCACTTAGTCAACGTTCATGGTAAGGTCTTGGACCGTAA GTCTATGGGTGAGGATTTATTCTGGGCTTTGAGAGGTGGTGGTGC TGAATCTTTCGGTATTATCGTCGCTTGGAAGATTAGATTAGTT GCTGTTCCAAAGTCTACTATGTTCTCTGTTAAGAAGATCATGGAA ATTCACGAGTTGGTTAAATTAGTTAACAAATGGCAAAACAT TGCCTACAAGTACGATAAAGATTTGTTATTAAT GACTCACTTTATCACTAGAAACATTACTGATAACCAAGGTAA GAATAAGACTGCCATTCACACTTACTTCTCTTCTGTTTTCTTGGG TGGTGTTGATTCCTTGGTCGATTTGATGAACAAGTCTTTTC CAGAATTAGGTATTAAGAAGACCGATTGTCGTCA ATTATCTTGGATTGATACCATTATTTTTTACTCCGGTGTTGTCAA CTACGACACTGATAATTTTAATAAGGAGATTTTGTT AGATAGATCTGCTGGTCAAAATGGTGCCTTTAAAATCAA ATTGGACTACGTTAAGAAGCCTATTCCAGAATCCGTCTTTGTTC AAATTTTGGAGAAGTTATACGAAGAAGATAT TGGTGCTGGTATGTACGCCTTGTATCCATATGGTGGTATTA TGGATGAAATTTCTGAATCCGCCATCCCTTTCCCTCATCGTGCTG GTATCTTATACGAGTTGTGGTACATCTGTTCTTGGGAAAAGCAAG AAGATAATGAAAAGCATTTGAACTGGATCCGTAACATCTATAA CTTCATGACTCCATACGTTTCCAAAAACCCTAGA TTGGCTTACTTAAATTACAGAGACTTAGATATTGGTATTAACGA CCCTAAGAACCCAAACAATTACACTCAAGCTAGAATCTGGGGTGA AAAGTACTTCGGTAAGAATTTCGACAGATTAGTTAAGGTCAAGAC TTTAGTTGACCCAAATAACTTCTTCAGAAACGAACAATCTATCCC ACCATTGCCTAGACATAGACACTAG |
| SEQ ID NO: 52 CBDA Synthase, F17M variant Artificial Sequence | MKCSTFSFWFVCKIIFMFFSFNIQTSIANPRENFLKCFSQYIPNN ATNLKLVYTQNNPLYMSVLNSTIHNLRFTSDTTPKPLVIVTPSHV SHIQGTILCSKKVGLQIRTRSGGHDSEGMSYISQVPFVIVDLRNM RSIKIDVHSQTAWVEAGATLGEVYYWVNEKNENLSLAAGYCPTVC AGGHFGGGGYGPLMRNYGLAADNIIDAHLVNVHGKVLDRKSMGED LFWALRGGGAESFGIIVAWKIRLVAWKSTMFSVKKIMEIHELVKL VNKWQNIAYKYDKDLLLMTHFITRNITDNQGKNKTAIHTYFSSWL GGVDSLVDLMNKSFPELGIKKTDCRQLSWIDTIIFYSGWNYDTDN FNKEILLDRSAGQNGAFKIKLDYVKKPIPESVFVQILEKLYEEDI GAGMYALYPYGGIMDEISESAIPFPHRAGILYELWYICSWEKQED NEKHLNWIRNIYNFMTPYVSKNPRLAYLNYRDLDIGINDPKNPNN YTQARIWGEKYFGKNFDRLVKVKTLVDPNNFFRNEQSIPPLPRHR H* |
| SEQ ID NO: 53 CBDA Synthase, F18T variant Artificial Sequence Codon optimized | ATGAAATGCTCCACTTTCTCTTTCTGGTTCGTTTGTAAGATTATC TTCTTCactTTTTCTTTCAACATCCAAACTTCCATTGCCAACCCT CGTGAGAACTTCTTGAAATGTTTTTCTCAATATATCCCAAATAAC GCTACTAACTTGAAGTTAGTCTATACTCAAAACAACCCATTATAT ATGTCTGTCTTAAACTCTACCATTCACAACTTACGTTTCACTTCT GATACTACTCCAAAACCTTTGGTCATCGTCACCCCATCCCACGTT TCTCACATCCAAGGTACCATCTTGTGTTCCAAAAAGGTTGGTTTA CAAATCCGTACTAGATCCGGTGGTCATGACTCCGAAGGTATGTCT TACATTTCCCAAGTCCCTTTCGTCATCGTCGACTTAAGA AATATGCGTTCCATCAAGATTGATGTCCATTCCCAAACTGC TTGGGTTGAAGCCGGTGCCACTTTAGGTGAAGTCTATTACTGGGT TAACGAGAAGAATGAGAACTTATCTTTGGCTGCCGGTTACTGTC CAACTGTTTGTGCTGGTGGTCATTTCGGTGGTGGTGGTTA |

TABLE 1-continued

| Amino acid and nucleotide sequences of the disclosure | |
|---|---|
| | CGGTCCATTAATGCGTAACTACGGTTTGGCTGCCGATAACATCAT TGATGCCCACTTAGTCAACGTTCATGGTAAGGTCTTGGACCGTAA GTCTATGGGTGAGGATTTATTCTGGGCTTTGAGAGGTGGTGGTGC TGAATCTTTCGGTATTATCGTCGCTTGGAAGATTAGATT AGTTGCTGTTCCAAAGTCTACTATGTTCTCTGTTAAG AAGATCATGGAAATTCACGAGTTGGTTAAA TTAGTTAACAAATGGCAAAACATTGCCTACAAGTACGAT AAAGATTTGTTATTAATGACTCACTTTATCACTAGAAACATTACT GATAACCAAGGTAAGAATAAGACTGCCATTCACACTTACTTCTCT TCTGTTTTCTTGGGTGGTGTTGATTCCTTGGTCGATTTGATGAAC AAGTCTTTTCCAGAATTAGGTATTAAGAAGACCGATTGTCGTCAA TTATCTTGGATTGATACCATTATTTTTTACTCCGGTGTTGTCAAC TACGACACTGATAATTTTAATAAGGAGATTTTGTTA GATAGATCTGCTGGTCAAAATGGTGCCTTTAAAATCA AATTGGACTACGTTAAGAAGCCTATTCCAGAATCCGTCTTTGTTC AAATTTTGGAGAAGTTATACGAAGAAGATATTGGTGCTGGTATGT ACGCCTTGTATCCATATGGTGGTATTATGGATGAAATT TCTGAATCCGCCATCCCTTTCCCTCATCGTGCTGGTATCTTATA CGAGTTGTGGTACATCTGTTCTTGGGAAAAGCAAGAAGATAATGA AAAGCATTTGAACTGGATCCGTAACATCTATAACTTCATGACTCC ATACGTTTCCAAAAACCCTAGATTGGCTTACTTAAATTACAG AGACTTAGATATTGGTATTAACGACCCTAAGAACCC AAACAATTACACTCAAGCTAGAATCTGGGGTGAAAAGTACTTC GGTAAGAATTTCGACAGATTAGTTAAGGTCAAGACTTTAGTTGAC CCAAATAACTTCTTCAGAAACGAACAATCTATCCCACCATTGCCT AGACATAGACACTAG |
| SEQ ID NO: 54 CBDA Synthase, F18T variant Artificial Sequence | MKCSTFSFWFVCKIIFFTFSFNIQTSIANPRENFLKCFSQYIPNN ATNLKJLVYTQNNPLYMSVLNSTIHNLRFTSDTTPKPLVIVTPSH VSHIQGTILCSKKVGLQIRTRSGGHDSEGMSYISQVPFVIVDLRN MRSIKIDVHSQTAWVEAGATLGEVYYWVNEKNENLSLAAGYCPTV CAGGHFGGGGYGPLMRNYGLAADNIIDAHLVNVHGKVLDRKSMGE DLFWALRGGGAESFGIIVAWKIRLVAVPKSTMFSVKKIMEIHELV KLVNKWQNIAYKYDKDLLLMTHFITRNITDNQGKNKTAIHTYFSS VFLGGVDSLVDLMNKSFPELGIKKTDCRQLSWIDTIIFYSGVVNY DTDNFNKEILLDRSAGQNGAFKIKLDYVKKPIPESVFVQILEKLY EEDIGAGMYALYPYGGIMDEISESAIPFPHRAGILYELWYICSWE KQEDNEKHLNWIRNIYNFMTPYVSKNPRLAYLNYRDLDIGINDPK NPNNYTQARIWGEKYFGKNFDRLVKVKTLVDPNNFFRN EQSIPPLPRHRH* |
| SEQ ID NO: 55 CBDA Synthase, F18W variant Artificial Sequence Codon optimized | ATGAAATGCTCCACTTTCTCTTTCTGGTTCGTTTGTAAGATTATC TTCTTCtggTTTTCTTTCAACATCCAAACTTCCATTGCCAACCCT CGTGAGAACTTCTTGAAATGTTTTTCTCAATATATCCCAAATAAC GCTACTAACTTGAAGTTAGTCTATACTCAAAACAACCCATTATAT ATGTCTGTCTTAAACTCTACCATTCACAACTTACGTTTCACTTCT GATACTACTCCAAAACCTTTGGTCATCGTCACCCCATCCCACGTT TCTCACATCCAAGGTACCATCTTGTGTTCCAAAAAGGTTGGTTT ACAAATCCGTACTAGATCCGGTGGTCATGACTCCGAAGGT ATGTCTTACATTTCCCAAGTCCCTTTCGTCATCGTCGACTTAAG AAATATGCGTTCCATCAAGATTGATGTCCATTCCCAAACTGCTTG GGTTGAAGCCGGTGCCACTTTAGGTGAAGTCTATTACTGGGTTAA CGAGAAGAATGAGAACTTATCTTTGGCTGCCGGTTACTGTCCAAC TGTTTGTGCTGGTGGTCATTTCGGTGGTGGTGGTTACGGTCCATT AATGCGTAACTACGGTTTGGCTGCCGATAACATCATTGATGCCCA CTTAGTCAACGTTCATGGTAAGGTCTTGGACCGTAAGTCTATGGG TGAGGATTTATTCTGGGCTTTGAGAGGTGGTGGTGCTGAATCTTT CGGTATTATCGTCGCTTGGAAGATTAGATTAGTTGCTGTTCCAAA GTCTACTATGTTCTCTGTTAAGAAGATCATGGAAATTCACGAGTT GGTTAAATTAGTTAACAAATGGCAAAACATTGCCTACA AGTACGATAAAGATTTGTTATTAATGACTCACT TTATCACTAGAAACATTACTGATAACCAAGGTAAGAATAAGACT GCCATTCACACTTACTTCTCTTCTGTTTTCTTGGGTGGTGTTGAT TCCTTGGTCGATTTGATGAACAAGTCTTTTCCAGAATTAGGTATT AAGAAGACCGATTGTCGTCAATTATCTTGGATTGATACCATTATT TTTTACTCCGGTGTTGTCAACTACGACACTGATAATTTTAATAAG GAGATTTTGTTAGATAGATCTGCTGGTCAAAATGGTGCCTTTAAA ATCAAATTGGACTACGTTAAGAAGCCTATTCCAGAATCCGTCTTT GTTCAAATTTTGGAGAAGTTATACGAAGAAGATATTGGTGCTGGT ATGTACGCCTTGTATCCATATGGTGGTATTATGGATGAAATTTCT GAATCCGCCATCCCTTTCCCTCATCGTGCTGGTATCTTATACGAG TTGTGGTACATCTGTTCTTGGGAAAAGCAAGAAGATAATGAAAAG CATTTGAACTGGATCCGTAACATCTATAACTTCATGACTC CATACGTTTCCAAAAACCCTAGATTGGCTTACTTAAA TTACAGAGACTTAGATATTGGTATTAACGACCCTAAGAACCCAAA CAATTACACTCAAGCTAGAATCTGGGGTGAAAAGTACTTCGGTAA GAATTTCGACAGATTAGTTAAGGTCAAGACTTTAGTTGACCCAAA |

TABLE 1-continued

| Amino acid and nucleotide sequences of the disclosure | |
|---|---|
| | TAACTTCTTCAGAAACGAACAATCTATCCCACCATTGCCTAGACA<br>TAGACACTAG |
| SEQ ID NO: 56<br>CBDA Synthase,<br>F18W<br>variant<br>Artificial<br>Sequence | MKCSTFSFWFVCKIIFFWFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCP<br>TVCAGGHFGGGGYGPLMRNYGLAADNIIDAHLVNVHGKVL<br>DRKSMGEDLFWALRGGGAESFGIIVAWKIRLVAVPKSTMFSVKKI<br>MEIHELVKLVNKWQNIAYKYDKDLLLMTHFITRNITDNQGKNKTA<br>IHTYFSSVFLGGVDSLVDLMNKSFPELGIKKTDCRQLSWIDTHFY<br>SGWNYDTDNFNKEILLDRSAGQNGAFKIKLDYVKKPIPESVFVQI<br>LEKLYEEDIGAGMYALYPYGGIMDEISESAIPFPHRAGILYELWY<br>ICSWEKQEDNEKHLNWIRNIYNFMTPYVSKNPRLAYLNYRDLDIG<br>INDPKNPNNYTQARIWGEKYFGKNFDRLVKVKTLVDPNNFFRNEQ<br>SIPPLPRHRH* |
| SEQ ID NO: 57<br>CBDA Synthase,<br>S20G<br>variant<br>Artificial<br>Sequence<br>Codon optimized | ATGAAATGCTCCACTTTCTCTTTCTGGTTCGTTTGTAAGATTATC<br>TTCTTCTTCTTTggtTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTT<br>ACAAATCCGTACTAGATCCGGTGGTCATGACTCCGA<br>AGGTATGTCTTACATTTCCCAAGTCCCTTTCGTCATCGTCGA<br>CTTAAGAAATATGCGTTCCATCAAGATTGATGTCCATTCCCAAAC<br>TGCTTGGGTTGAAGCCGGTGCCACTTTAGGTGAAGTCTATTACTG<br>GGTTAACGAGAAGAATGAGAACTTATCTTTGGCTGCCGGTTACTG<br>TCCAACTGTTTGTGCTGGTGGTCATTTCGGTGGTGGTGGTTACGG<br>TCCATTAATGCGTAACTACGGTTTGGCTGCCGATAACATCATTG<br>ATGCCCACTTAGTCAACGTTCATGGTAAGGTCTTGGACCGTAAGT<br>CTATGGGTGAGGATTTATTCTGGGCTTTGAGAGGTGGTGGTG<br>CTGAATCTTTCGGTATTATCGTCGCTTGGAAGATTAGATTAGT<br>TGCTGTTCCAAAGTCTACTATGTTCTCTGTTAAGAAGATCATG<br>GAAATTCACGAGTTGGTTAAATTAGTTAACAAAT<br>GGCAAAACATTGCCTACAAGTACGATAAAGATTTGTTATTAATGA<br>CTCACTTTATCACTAGAAACATTACTGATAACCAAGGTAAGAATA<br>AGACTGCCATTCACACTTACTTCTCTTCTGTTTTCTTGGGTGGTG<br>TTGATTCCTTGGTCGATTTGATGAACAAGTCTTTTCCAGAATTAG<br>GTATTAAGAAGACCGATTGTCGTCAATTGATAATTTTAATAAGGA<br>GATTTTGTTAGATAGATCTGCTGGTCAAAATGGTGCCTTTAAAAT<br>CAAATTGGACTACGTTAAGAAGCCTATTCCAGAATCCGTCTTTGT<br>TCAAATTTTGGAGAAGTTATACGAAGAAGATATTGGTGCTGGTAT<br>GTACGCCTTGTATCCATATGGTGGTATTATGGATGAAATTTCTGA<br>ATCCGCCATCCCTTTCCCTCATCGTGCTGGTATCTTATACGAGTT<br>GTGGTACATCTGTTCTTGGGAAAAGCAAGAAGATAATGAAAAGCA<br>TTTGAACTGGATCCGTAAC<br>ATCTATAACTTCATGACTCCATACGTTTCCAAAAACCCTAGATTG<br>GCTTACTTAAATTACAGAGACTTAGATATTGGTATTAACGACCCT<br>AAGAACCCAAACAATTACACTCAAGCTAGAATCTGGGGTGAAAAG<br>TACTTCGGTAAGAATTTCGACAGATTAGTTAAGGTCAAGACTTTA<br>GTTGACCCAAATAACTTCTTCAGAAACGAACAATCTATCCCACCA<br>TTGCCTAGACATAGACACTAG |
| SEQ ID NO: 58<br>CBDA Synthase, S20G<br>variant<br>Artificial Sequence | MKCSTFSFWFVCKIIFFFFGFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGVVNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>RHRH* |
| SEQ ID NO: 59<br>CBDA Synthase, R31Q<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>caaGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTT<br>ACAAATCCGTACTAGATCCGGTGGTCATGACTCCGAAGGT<br>ATGTCTTACATTTCCCAAGTCCCTTTCGTCATCGTCGACTTAAG |

TABLE 1-continued

| Amino acid and nucleotide sequences of the disclosure | |
|---|---|
| | AAATATGCGTTCCATCAAGATTGATGTCCATTCCCAAACTGCTTG<br>GGTTGAAGCCGGTGCCACTTTAGGTGAAGTCTATTACTGGGTTAA<br>CGAGAAGAATGAGAACTTATCTTTGGCTGCCGGTTACTGTCCAAC<br>TGTTTGTGCTGGTGGTCATTTCGGTGGTGGTGGTTACGGTCCATT<br>AATGCGTAACTACGGTTTGGCTGCCGATAACATCATTGATGCCCA<br>CTTAGTCAACGTTCATGGTAAGGTCTTGGACCGTAAGTCTATGGG<br>TGAGGATTTATTCTGGGCTTTGAGAGGTGGTGGTGCTGAATCTTT<br>CGGTATTATCGTCGCTTGGAAGATTAGATTAGTTGCTGTTCCAAA<br>GTCTACTATGTTCTCTGTTAAGAAGATCATGGAAATTCACGAGTT<br>GGTTAAATTAGTTAACAAATGGCAAAACATTGCCTACAAGTACGA<br>TAAAGATTTGTTATTAATGACTCACTTTATCACTAGAAACATTAC<br>TGATAACCAAGGTAAGAATAAGACTGCCATTCACACTTACTTCTC<br>TTCTGTTTTCTTGGGTGGTGTTGATTCCTTGGTCGATTTGATGA<br>ACAAGTCTTTTCCAGAATTAGGTATTAAGAAGACCG<br>ATTGTCGTCAATTATCTTGGATTGATACCATTATTTTTTACTCC<br>GGTGTTGTCAACTACGACACTGATAATTTTAATAAGGAG<br>ATTTTGTTAGATAGATCTGCTGGTCAAAATGGTG<br>CCTTTAAAATCAAATTGGACTACGTTAAGAAGCCTATTCCAGAAT<br>CCGTCTTTGTTCAAATTTTGGAGAAGTTATACGAAGAAGATATTG<br>GTGCTGGTATGTACGCCTTGTATCCATATGGTGGTATTATGGATG<br>AAATTTCTGAATCCGCCATCCCTTTCCCTCATCGTGCTGGTATCT<br>TATACGAGTTGTGGTACATCTGTTCTTGGGAAAAGCAAGAAGATA<br>ATGAAAAGCATTTGAACTGGATCCGTAACATCTATAACTTC<br>ATGACTCCATACGTTTCCAAAAACCCTAGATTG<br>GCTTACTTAAATTACAGAGACTTAGATATTGGT<br>ATTAACGACCCTAAGAACCCAAACAATTACACTCAAGCTAGAA<br>TCTGGGGTGAAAAGTACTTCGGTAAGAATTTCGACAGATTAGTTA<br>AGGTCAAGACTTTAGTTGACCCAAATAACTTCTTCAGAAACGAAC<br>AATCTATCCCACCATTGCCTAGACATAGACACTAG |
| SEQ ID NO: 60<br>CBDA Synthase, R31Q variant<br>Artificial Sequence | MKCSTFSFWFVCKIIFFFFSFNIQTSIANPQENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSW<br>LGGVDSLVDLMNKSFPELGIKKTDCRQLSWIDTIIFYSGWNYDTD<br>NFNKEILLDRSAGQNGAFKIKLDYVKKPIPESVFVQILEKLYEED<br>IGAGMYALYPYGGIMDEISESAIPFPHRAGILYELWYICSWEKQE<br>DNEKHLNWIRNIYNFMTPYVSKNPRLAYLNYRDLDIGINDPKNPN<br>NYTQARIWGEKYFGKNFDRLVKVKTLVDPNNFFRNEQSIPPLPRH<br>RH* |
| SEQ ID NO: 61<br>CBDA Synthase, N33K variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGaaaTTCTTGAAATGTTTTTCTCAATATATCCCA<br>AATAACGCTACTAACTTGAAGTTAGTCTATACTCAAAA<br>CAACCCATTATATATGTCTGTCTTAAACTCTACCATTCACAACTT<br>ACGTTTCACTTCTGATACTACTCCAAAACCTTTGGTCATCGTCAC<br>CCCATCCCACGTTTCTCACATCCAAGGTACCATCTTGTGTTCCAA<br>AAAGGTTGGTTTACAAATCCGTACTAGATCCGGTGGTCA<br>TGACTCCGAAGGTATGTCTTACATTTCCCAAGTCCCTTTCG<br>TCATCGTCGACTTAAGAAATATGCGTTCCATCAAGATTGATGTCC<br>ATTCCCAAACTGCTTGGGTTGAAGCCGGTGCCACTTTAGGTGAAG<br>TCTATTACTGGGTTAACGAGAAGAATGAGAACTTATCTTTGGCTG<br>CCGGTTACTGTCCAACTGTTTGTGCTGGTGGTCATTTCGGTGGTG<br>GTGGTTACGGTCCATTAATGCGTAACTACGGTTTGGCTGCCGATA<br>ACATCATTGATGCCCACTTAGTCAACGTTCATGGTAAGGTCTTGG<br>ACCGTAAGTCTATGGGTGAGGATTTATTCTGGGCTTTGAGAGGTG<br>GTGGTGCTGAATCTTTCGGTATTATCGTCGCTTGGAAGATTAG<br>ATTAGTTGCTGTTCCAAAGTCTACTATGTTCTCTGTTAAGAAGAT<br>CATGGAAATTCACGAGTTGGTTAAATTAGTTAACAAA<br>TGGCAAAACATTGCCTACAAGTACGATAAAGA<br>TTTGTTATTAATGACTCACTTTATCACTAGAAACATTAC<br>TGATAACCAAGGTAAGAATAAGACTGCCATTCACACTTACTTCTC<br>TTCTGTTTTCTTGGGTGGTGTTGATTCCTTGGTCGATTTGATGAA<br>CAAGTCTTTTCCAGAATTAGGTATTAAGAAGACCGATTGTCGTCA<br>ATTATCTTGGATTGATACCATTATTTTTTACTCCGGTGTTGTCAA<br>CTACGACACTGATAATTTTAATAAGGAGATTTTGTTA<br>GATAGATCTGCTGGTCAAAATGGTGCCTTTAAAATCAA<br>ATTGGACTACGTTAAGAAGCCTATTCCAGAATCCGTCTTTGTTC<br>AAATTTTGGAGAAGTTATACGAAGAAGATATTGG<br>TGCTGGTATGTACGCCTTGTATCCATATGGTGGTATTA<br>TGGATGAAATTTCTGAATCCGCCATCCCTTTCCCTCATC<br>GTGCTGGTATCTTATACGAGTTGTGGTACATCTGTTCTTGGGAAA<br>AGCAAGAAGATAATGAAAAGCATTTGAACTGGATCCGTAACATCT<br>ATAACTTCATGACTCCATACGTTTCCAAAAACC |

TABLE 1-continued

| Amino acid and nucleotide sequences of the disclosure | |
|---|---|
| | CTAGATTGGCTTACTTAAATTACAGAGACTTAGATATTGGTA<br>TTAACGACCCTAAGAACCCAAACAATTACACTCAAGCTAGAATCT<br>GGGGTGAAAAGTACTTCGGTAAGAATTTCGACAGATTAGTTAAGG<br>TCAAGACTTTAGTTGACCCAAATAACTTCTTCAGAAACGAACAAT<br>CTATCCCACCATTGCCTAGACATAGACACTAG |
| SEQ ID NO: 62<br>CBDA Synthase, N33K<br>variant<br>Artificial Sequence | MKCSTFSFWFVCKIIFFFFSFNIQTSIANPREKFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKIKLDYVKKPIPESVFVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP<br>NNYTQARIWGEKYFGKNFDRLVKVKTLVDPNNFFRNEQSIPPLPR<br>HRH* |
| SEQ ID NO: 63<br>CBDA Synthase, P43E<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCgaaAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGT<br>TGGTTAAATTAGTTAACAAATGGCAAAACATTGCCTA<br>CAAGTACGATAAAGATTTGTTATTAATGACTCAC<br>TTTATCACTAGAAACATTACTGATAACCAAGGTAA<br>GAATAAGACTGCCATTCACACTTACTTCTCTTCTGTTTTCT<br>TGGGTGGTGTTGATTCCTTGGTCGATTTGATGAACAAGTCTTTTC<br>CAGAATTAGGTATTAAGAAGACCGATTGTCGTCAACTGATAATTT<br>TAATAAGGAGATTTTGTTAGATAGATCTGCTGGTCAAAATGGTGC<br>CTTTAAAATCAAATTGGACTACGTTAAGAAGCCTATTCCAGAATC<br>CGTCTTTGTTCAAATTTTGGAGAAGTTATACGAAGAAGATATTGG<br>TGCTGGTATGTACGCCTTGTATCCATATGGTGGTATTATGGATGA<br>AATTTCTGAATCCGCCATCCCTTTCCCTCATCGTGCTGGTATCTT<br>ATACGAGTTGTGGTACATCTGTTCTTGGGAAAAGCAAGAAGATAA<br>TGAAAAGCATTTGAACTGGATCCGTAACATCTATAACTTCATGAC<br>TCCATACGTTTCCAAAAACCCTAGATTGGCTTACTTAAATTAC<br>AGAGACTTAGATATTGGTATTAACGACCCTAAGAAC<br>CCAAACAATTACACTCAAGCTAGAATCTGGGGTGAAAAGTACTT<br>CGGTAAGAATTTCGACAGATTAGTTAAGGTCAAGACTTTAGTTGA<br>CCCAAATAACTTCTTCAGAAACGAACAATCTATCCCACCATTGCC<br>TAGACATAGACACTAG |
| SEQ ID NO: 64<br>CBDA Synthase, P43E<br>variant<br>Artificial Sequence | MKCSTFSFWFVCKIIFFFFSFNIQTSIANPRENFLKCFSQYIENN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTV<br>CAGGHFGGGGYGPLMRNYGLAADNIIDAHLVNVHGKVLDRK<br>SMGEDLFWALRGGGAESFGIIVAWKIRLVAVPKSTMFSVKKIMEI<br>HELVKLVNKWQNIAYKYDKDLLLMTHFITRNITDNQGKNKTAIHT<br>YFSSWLGGVDSLVDLMNKSFPELGIKKTDCRQLSWIDTIIFYSGV<br>VNYDTDNFNKEILLDRSAGQNGAFKKLDYVKKPIPESVFVQILEK<br>LYEEDIGAGMYALYPYGGIMDEISESAIPFPHRAGILYELWYICS<br>WEKQEDNEKHLNWIRNIYNFMTPYVSKNPRLAYLNYRDLDIGIND<br>PKNPNNYTQARIWGEKYFGKNFDRLVKVKTLVDPNNFFRNE<br>QSIPPLPRHRH* |
| SEQ ID NO: 65<br>CBDA Synthase, L49E<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGATACTCAAAACAACCCATTATATATGTCTG<br>TCTTAAACTCTACCATTCACAACTTACGTTTCACTTCTGATACTA<br>CTCCAAAACCTTTGGTCATCGTCACCCCATCCCACGTTTCTCACA<br>TCCAAGGTACCATCTTGTGTTCCAAAAAGGTTGGTTTACAAATC |

TABLE 1-continued

| Amino acid and nucleotide sequences of the disclosure | |
|---|---|
| | CGTACTAGATCCGGTGGTCATGACTCCGAAGGTATGTCTTACATT<br>TCCCAAGTCCCTTTCGTCATCGTCGACTTAAGAAATATGCGTTCC<br>ATCAAGATTGATGTCCATTCCCAAACTGCTTGGGTTGAAGCCGGT<br>GCCACTTTAGGTGAAGTCTATTACTGGGTTAACGAGAAGAATGAG<br>AACTTATCTTTGGCTGCCGGTTACTGTCCAACTGTTTGTGCTGGT<br>GGTCATTTCGGTGGTGGTGGTTACGGTCCATTAATGCGTAACTAC<br>GGTTTGGCTGCCGATAACATCATTGATGCCCACTTAGTCAAC<br>GTTCATGGTAAGGTCTTGGACCGTAAGTCTATGGGTGAGGA<br>TTTATTCTGGGCTTTGAGAGGTGGTGGTGCTGAATCTTTCGGTAT<br>TATCGTCGCTTGGAAGATTAGATTAGTTGCTGTTCCAAAGTCTAC<br>TATGTTCTCTGTTAAGAAGATCATGGAAATTCACGAGTTGGTTAA<br>ATTAGTTAACAAATGGCAAAACATTGCCTACAAGTACGATAAAGA<br>TTTGTTATTAATGACTCACTTTATCACTAGAAACATT<br>ACTGATAACCAAGGTAAGAATAAGACTGCCATTCAC<br>ACTTACTTCTCTTCTGTTTTCTTGGGTGGTGTTGATTCCTTGGTC<br>GATTTGATGAACAAGTCTTTTCCAGAATTAGGTATTAAGAAGACC<br>GATTGTCGTCAACTGATAATTTTAATAAGGAGATTTT<br>GTTAGATAGATCTGCTGGTCAAAATGGTGCCTTTAAAA<br>TCAAATTGGACTACGTTAAGAAGCCTATTCCAGAATCCGTCTTTG<br>TTCAAATTTTGGAGAAGTTATACGAAGAAGATATTGGTGCTGGTA<br>TGTACGCCTTGTATCCATATGGTGGTATTATGGATGAAATTTCTG<br>AATCCGCCATCCCTTTCCCTCATCGTGCTGGTATCTT<br>ATACGAGTTGTGGTACATCTGTTCTTGGGAAAAGCAAGA<br>AGATAATGAAAAGCATTTGAACTGGATCCGTAACATCTATAACTT<br>CATGACTCCATACGTTTCCAAAAACCCTAGATTGGCTTACTTAA<br>ATTACAGAGACTTAGATATTGGTATTAACGACCCT<br>AAGAACCCAAACAATTACACTCAAGCTAGAATCTGGGGT<br>GAAAAGTACTTCGGTAAGAATTTCGACAGATTAGTTAAGGTCAAG<br>ACTTTAGTTGACCCAAATAACTTCTTCAGAAACGAACAATC<br>TATCCCACCATTGCCTAGACATAGACACTAG |
| SEQ ID NO: 66<br>CBDA Synthase, L49E<br>variant<br>Artificial Sequence | MKCSTFSFWFVCKIIFFFFSFNIQTSIANPRENFLKCFSQYIPNN<br>ATNEKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPT<br>VCAGGHFGGGGYGPLMRNYGLAADNIIDAHLVNVHGKVLDRKSM<br>GEDLFWALRGGGAESFGIIVAWKIRLVAVPKSTMFSVKKIMEIHE<br>LVKLVNKWQNIAYKYDKDLLLMTHFITRNITDNQGKNKTAIHTYF<br>SSVFLGGVDSLVDLMNKSFPELGIKKTDCRQLSWIDTIIFYSGWN<br>YDTDNFNKEILLDRSAGQNGAFKIKLDYVKKPIPESVFVQILEKL<br>YEEDIGAGMYALYPYGGIMDEISESAIPFPHRAGILYELWYICSW<br>EKQEDNEKHLNWIRNIYNFMTPYVSKNPRLAYLNYRDLDIGINDP<br>KNPNNYTQARIWGEKYFGKNFDRLVKVKTLVDPNNFFRNEQSIPP<br>LPRHRH* |
| SEQ ID NO: 67<br>CBDA Synthase, L49K<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACaaaAAGTTAGTCTATACTCAAAACAACCCATTATA<br>TATGTCTGTCTTAAACTCTACCATTCACAACTTACGTTTCACTTC<br>TGATACTACTCCAAAACCTTTGGTCATCGTCACCCCATCCCACGT<br>TTCTCACATCCAAGGTACCATCTTGTGTTCCAAAAAGGTTGGTTT<br>ACAAATCCGTACTAGATCCGGTGGTCATGACTCCGAAGGTATGTC<br>TTACATTTCCCAAGTCCCTTTCGTCATCGTCGACTTAAGAAATAT<br>GCGTTCCATCAAGATTGATGTCCATTCCCAAACTGCTTGGGTTGA<br>AGCCGGTGCCACTTTAGGTGAAGTCTATTACTGGGTTAACGAGAA<br>GAATGAGAACTTATCTTTGGCTGCCGGTTACTGTCCAACTGTTTG<br>TGCTGGTGGTCATTTCGGTGGTGGTGGTTACGGTCCATTAATGCG<br>TAACTACGGTTTGGCTGCCGATAACATCATTGATGCCCACTTAGT<br>CAACGTTCATGGTAAGGTCTTGGACCGTAAGTCTATGGGTGAGGA<br>TTTATTCTGGGCTTTGAGAGGTGGTGGTGCTGAATCTTTCGGTAT<br>TATCGTCGCTTGGAAGATTAGATTAGTTGCTGTTCCAAAGTCTAC<br>TATGTTCTCTGTTAAGAAGATCATGGAAATTCACGAGTTGGTTA<br>AATTAGTTAACAAATGGCAAAACATTGCCTACAAG<br>TACGATAAAGATTTGTTATTAATGACTCACTTTATC<br>ACTAGAAACATTACTGATAACCAAGGTAAGAATAAGACTGC<br>CATTCACACTTACTTCTCTTCTGTTTTCTTGGGTGGTGTTGATTC<br>CTTGGTCGATTTGATGAACAAGTCTTTTCCAGAATTAGGTATTAA<br>GAAGACCGATTGTCGTCAACTGATAATTTTAATAAGGAGATTTTG<br>TTAGATAGATCTGCTGGTCAAAATGGTGCCTTTAAAATCAAATTG<br>GACTACGTTAAGAAGCCTATTCCAGAATCCGTCTTTGTTCAAATT<br>TTGGAGAAGTTATACGAAGAAGATATTGGTGCTGGTATGTACGCC<br>TTGTATCCATATGGTGGTATTATGGATGAAATTTCTGAATCCGCC<br>ATCCCTTTCCCTCATCGTGCTGGTATCTTATACGAGTTGTGGTAC<br>ATCTGTTCTTGGGAAAAGCAAGAAGATAATGAAAAGCATTTGAAC<br>TGGATCCGTAACATCTATAACTTCATGACTCCATACGTTTCCAAA<br>AACCCTAGATTGGCTTACTTAAATTACAGAGACTTAGATA<br>TTGGTATTAACGACCCTAAGAACCCAAACAATTACACTC |

TABLE 1-continued

| Amino acid and nucleotide sequences of the disclosure | |
|---|---|
| | AAGCTAGAATCTGGGGTGAAAAGTACTTCGGTAAGAATTTCGAC<br>AGATTAGTTAAGGTCAAGACTTTAGTTGACCCAA<br>ATAACTTCTTCAGAAACGAACAATCTATCCCACCATTGCCTAG<br>ACATAGACACTAG |
| SEQ ID NO: 68<br>CBDA Synthase, L49K<br>variant<br>Artificial Sequence | MKCSTFSFWFVCKIIFFFFSFNIQTSIANPRENFLKCFSQYIPNN<br>ATNKKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCP<br>TVCAGGHFGGGGYGPLMRNYGLAADNIIDAHLVNVHGKVLDR<br>KSMGEDLFWALRGGGAESFGIIVAWKIRLVAVPKSTMFSVKKIME<br>IHELVKLVNKWQNIAYKYDKDLLLMTHFITRNITDNQGKNKT<br>AIHTYFSSVFLGGVDSLVDLMNKSFPELGIKKTDCRQLSWID<br>TIIFYSGVVNYDTDNFNKEILLDRSAGQNGAFKIKLDYVKKPIPE<br>SVFVQILEKLYEEDIGAGMYALYPYGGIMDEISESAIPFPHRAGI<br>LYELWYICSWEKQEDNEKHLNWIRNIYNFMTPYVSKNPRLAYLNY<br>RDLDIGINDPKNPNNYTQARIWGEKYFGKNFDRLVKVKTLVDPNN<br>FFRNEQSIPPLPRHRH* |
| SEQ ID NO: 69<br>CBDA Synthase, L49Q<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAA<br>CGCTACTAACcaaAAGTTAGTCTATACTCAAAACAACCCATTATA<br>TATGTCTGTCTTAAACTCTACCATTCACAACTTACGTTTCACTTC<br>TGATACTACTCCAAAACCTTTGGTCATCGTCACCCCATCCCACGT<br>TTCTCACATCCAAGGTACCATCTTGTGTTCCAAAAAGGTTGGTTT<br>ACAAATCCGTACTAGATCCGGTGGTCATGACTCCGAAGGTATGTC<br>TTACATTTCCCAAGTCCCTTTCGTCATCGTCGACTTAAGAAATAT<br>GCGTTCCATCAAGATTGATGTCCATTCCCAAACTGCTTGGGTTGA<br>AGCCGGTGCCACTTTAGGTGAAGTCTATTACTGGGTTAACGAGAA<br>GAATGAGAACTTATCTTTGGCTGCCGGTTACTGTCCAACTGTTTG<br>TGCTGGTGGTCATTTCGGTGGTGGTGGTTACGGTCCATTAATGCG<br>TAACTACGGTTTGGCTGCCGATAACATCATTGATGCCCACTTAGT<br>CAACGTTCATGGTAAGGTCTTGGACCGTAAGTCTATGGGTG<br>AGGATTTATTCTGGGCTTTGAGAGGTGGTGGTGCTGAATCTTTCG<br>GTATTATCGTCGCTTGGAAGATTAGATTAGTTGCTGTTCCAAAGT<br>CTACTATGTTCTCTGTTAAGAAGATCATGGAAATTCACGAGTTGG<br>TTAAATTAGTTAACAAATGGCAAAACATTGCCTACAAGTACGATA<br>AAGATTTGTTATTAATGACTCACTTTATCACTAGAAACATTACTG<br>ATAACCAAGGTAAGAATAAGACTGCCATTCACACTTACTTCTCTT<br>CTGTTTTCTTGGGTGGTGTTGATTCCTTGGTCGATTTGATGAACA<br>AGTCTTTTCCAGAATTAGGTATTAAGAAGACCGATTGTCGTCAAC<br>TGATAATTTTAATAAGGAGATTTTGTTAGATAGATCTGCTGGTCA<br>AAATGGTGCCTTTAAAATCAAATTGGACTACGTTAAGAAGCCTAT<br>TCCAGAATCCGTCTTTGTTCAAATTTTGGAGAAGTTATACGAAGA<br>AGATATTGGTGCTGGTATGTACGCCTTGTATCCATATGGTGGTAT<br>TATGGATGAAATTTCTGAATCCGCCATCCCTTTCCCTCATCGTGC<br>TGGTATCTTATACGAGTTGTGGTACATCTGTTCTTGGGAAAAGCA<br>AGAAGATAATGAAAAGCATTTGAACTGGATCCGTAACATCTATAA<br>CTTCATGACTCCATACGTTTCCAAAAACCCTAGATTGGCTTACTT<br>AAATTACAGAGACTTAGATATTGGTATTAACGACCCTAAGAACCC<br>AAACAATTACACTCAAGCTAGAATCTGGGGTGAAAAGTACTTCGG<br>TAAGAATTTCGACAGATTAGTTAAGGTCAAGACTTTAGTTGACCC<br>AAATAACTTCTTCAGAAACGAACAATCTATCCCACCATTGCCTAG<br>ACATAGACACTAG |
| SEQ ID NO: 70<br>CBDA Synthase, L49Q<br>variant<br>Artificial Sequence | MKCSTFSFWFVCKIIFFFFSFNIQTSIANPRENFLKCFSQYIPNN<br>ATNQKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGVVNYD<br>TDNFNKEILLDRSAGQNGAFKKLDYVKKPIPESVFVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP<br>NNYTQARIWGEKYFGKNFDRLVKVKTLVDPNNFFRNEQSIPPLPR<br>HRH* |
| SEQ ID NO: 71<br>CBDA Synthase, K50T<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGactTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT |

TABLE 1-continued

| Amino acid and nucleotide sequences of the disclosure | |
|---|---|
| | TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTC<br>GACAGATTAGTTAAGGTCAAGACTTTAGTTGACCCAAATAACTTC<br>TTCAGAAACGAACAATCTATCCCACCATTGCCTAGACATAGACAC<br>TAG |
| SEQ ID NO: 72<br>CBDA Synthase, K50T<br>variant<br>Artificial Sequence | MKCSTFSFWFVCKIIFFFFSFNIQTSIANPRENFLKCFSQYIPNN<br>ATNLTLVYTQNNPLYMSVLNSTIHNLRFTSDTTPKPLVIVTPSHV<br>SHIQGTILCSKKVGLQTRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSW<br>LGGVDSLVDLMNKSFPELGIKKTDCRQLSWIDTHFYSGWNYDTDN<br>FNKEILLDRSAGQNGAFKKLDYVKKPIPESVFVQILEKLYEEDIG<br>AGMYALYPYGGIMDEISESAIPFPHRAGILYELWYICSWEKQEDN<br>EKHLNWIRNIYNFMTPYVSKNPRLAYLNYRDLDIGINDPKNPNNY<br>TQARIWGEKYFGKNFDRLVKVKTLVDPNNFFRNEQSIPPLPRHR<br>H* |
| SEQ ID NO: 73<br>CBDA Synthase, L51I<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGattGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA |

TABLE 1-continued

| Amino acid and nucleotide sequences of the disclosure | |
|---|---|
| | ACTTCTTCAGAAACGAACAATCTATCCCACCATTGCCTAGACATA GACACTAG |
| SEQ ID NO: 74 CBDA Synthase, L51I variant Artificial Sequence | MKCSTFSFWFVCKIIFFFFSFNIQTSIANPRENFLKCFSQYTPNN ATNLKIVYTQNNPLYMSVLNSTIHNLRFTSDTTPKPLVIVTPSHV SHIQGTILCSKKVGLQIRTRSGGHDSEGMSYISQVPFVIVDLRNM RSIKIDVHSQTAWVEAGATLGEVYYWVNEKNENLSLAAGYCPTVC AGGHFGGGGYGPLMRNYGLAADNIIDAHLVNVHGKVLDRKSMGED LFWALRGGGAESFGIIVAWKIRLVAWKSTMFSVKKIMEIHELVKL VNKWQNIAYKYDKDLLLMTHFITRNITDNQGKNKTAIHTYFSSWL GGVDSLVDLMNKSFPELGIKKTDCRQLSWIDTIIFYSGVVNYDTD NFNKEILLDRSAGQNGAFKIKLDYVKKPIPESVFVQILEKLYEED IGAGMYALYPYGGIMDEISESAIPFPHRAGILYELWYICSWEKQE DNEKHLNWIRNIYNFMTPYVSKNPRLAYLNYRDLDIGINDPKNPN NYTQARIWGEKYFGKNFDRLVKVKTLVDPNNFFRNEQSIPPLPRH RH* |
| SEQ ID NO: 75 CBDA Synthase, Q55E variant Artificial Sequence Codon optimized | ATGAAATGCTCCACTTTCTCTTTCTGGTTCGTTTGTAAGATTATC TTCTTCTTCTTTTCTTTCAACATCCAAACTTCCATTGCCAACCCT CGTGAGAACTTCTTGAAATGTTTTTCTCAATATATCCCAAATAAC GCTACTAACTTGAAGTTAGTCTATACTgaaAACAACCCATTATAT ATGTCTGTCTTAAACTCTACCATTCACAACTTACGTTTCACTTCT GATACTACTCCAAAACCTTTGGTCATCGTCACCCCATCCCACGTT TCTCACATCCAAGGTACCATCTTGTGTTCCAAAAAGGTTGGTTTA CAAATCCGTACTAGATCCGGTGGTCATGACTCCGAAGGTATGTCT TACATTTCCCAAGTCCCTTTCGTCATCGTCGACTTAAGAAATATG CGTTCCATCAAGATTGATGTCCATTCCCAAACTGCTTGGGTTGAA GCCGGTGCCACTTTAGGTGAAGTCTATTACTGGGTTAACGAGAAG AATGAGAACTTATCTTTGGCTGCCGGTTACTGTCCAACTGTTTGT GCTGGTGGTCATTTCGGTGGTGGTGGTTACGGTCCATTAATGCGT AACTACGGTTTGGCTGCCGATAACATCATTGATGCCCACTTAGTC AACGTTCATGGTAAGGTCTTGGACCGTAAGTCTATGGGTGAGGAT TTATTCTGGGCTTTGAGAGGTGGTGGTGCTGAATCTTTCGGTATT ATCGTCGCTTGGAAGATTAGATTAGTTGCTGTTCCAAAGTCTACT ATGTTCTCTGTTAAGAAGATCATGGAAATTCACGAGTTGGTTAAA TTAGTTAACAAATGGCAAAACATTGCCTACAAGTACGATAAAGAT TTGTTATTAATGACTCACTTTATCACTAGAAACATTACTGATAAC CAAGGTAAGAATAAGACTGCCATTCACACTTACTTCTCTTCTGTT TTCTTGGGTGGTGTTGATTCCTTGGTCGATTTGATGAACAAGTCT TTTCCAGAATTAGGTATTAAGAAGACCGATTGTCGTCAATTATCT TGGATTGATACCATTATTTTTTACTCCGGTGTTGTCAACTACGAC ACTGATAATTTTAATAAGGAGATTTTGTTAGATAGATCTGCTGGT CAAAATGGTGCCTTTAAAATCAAATTGGACTACGTTAAGAAGCCT ATTCCAGAATCCGTCTTTGTTCAAATTTTGGAGAAGTTATACGAA GAAGATATTGGTGCTGGTATGTACGCCTTGTATCCATATGGTGGT ATTATGGATGAAATTTCTGAATCCGCCATCCCTTTCCCTCATCGT GCTGGTATCTTATACGAGTTGTGGTACATCTGTTCTTGGGAAAAG CAAGAAGATAATGAAAAGCATTTGAACTGGATCCGTAACATCTAT AACTTCATGACTCCATACGTTTCCAAAAACCCTAGATTGGCTTAC TTAAATTACAGAGACTTAGATATTGGTATTAACGACCCTAAGAAC CCAAACAATTACACTCAAGCTAGAATCTGGGGTGAAAAGTACTTC GGTAAGAATTTCGACAGATTAGTTAAGGTCAAGACTTTAGTTGAC CCAAATAACTTCTTCAGAAACGAACAATCTATCCCACCATTGCCT AGACATAGACACTAG |
| SEQ ID NO: 76 CBDA Synthase, Q55E variant Artificial Sequence | MKCSTFSFWFVCKIIFFFFSFNIQTSIANPRENFLKCFSQYIPNN ATNLKLVYTENNPLYMSVLNSTIHNLRFTSDTTPKPLVIVTPSHV SHIQGTILCSKKVGLQIRTRSGGHDSEGMSYISQVPFVIVDLRNM RSIKIDVHSQTAWVEAGATLGEVYYWVNEKNENLSLAAGYCPTVC AGGHFGGGGYGPLMRNYGLAADNIIDAHLVNVHGKVLDRKSMGED LFWALRGGGAESFGIIVAWKIRLVAVPKSTMFSVKKIMEIHELVK LVNKWQNIAYKYDKDLLLMTHFITRNITDNQGKNKTAIHTYFSSW LGGVDSLVDLMNKSFPELGIKKTDCRQLSWIDTIIFYSGVVNYDTD NFNKEILLDRSAGQNGAFKIKLDYVKKPIPESVFVQILEKLYEED IGAGMYALYPYGGIMDEISESAIPFPHRAGILYELWYICSWEKQE DNEKHLNWIRNIYNFMTPYVSKNPRLAYLNYRDLDIGINDPKNPN NYTQARIWGEKYFGKNFDRLVKVKTLVDPNNFFRNEQSIPPLPRH RH* |
| SEQ ID NO: 77 CBDA Synthase, Q55P variant Artificial Sequence Codon optimized | ATGAAATGCTCCACTTTCTCTTTCTGGTTCGTTTGTAAGATTATC TTCTTCTTCTTTTCTTTCAACATCCAAACTTCCATTGCCAACCCT CGTGAGAACTTCTTGAAATGTTTTTCTCAATATATCCCAAATAAC GCTACTAACTTGAAGTTAGTCTATACTccaAACAACCCATTATAT ATGTCTGTCTTAAACTCTACCATTCACAACTTACGTTTCACTTCT GATACTACTCCAAAACCTTTGGTCATCGTCACCCCATCCCACGTT TCTCACATCCAAGGTACCATCTTGTGTTCCAAAAAGGTTGGTTTA CAAATCCGTACTAGATCCGGTGGTCATGACTCCGAAGGTATGTCT TACATTTCCCAAGTCCCTTTCGTCATCGTCGACTTAAGAAATATG |

TABLE 1-continued

| Amino acid and nucleotide sequences of the disclosure | |
|---|---|
| | CGTTCCATCAAGATTGATGTCCATTCCCAAACTGCTTGGGTTGAA GCCGGTGCCACTTTAGGTGAAGTCTATTACTGGGTTAACGAGAAG AATGAGAACTTATCTTTGGCTGCCGGTTACTGTCCAACTGTTTGT GCTGGTGGTCATTTCGGTGGTGGTGGTTACGGTCCATTAATGCGT AACTACGGTTTGGCTGCCGATAACATCATTGATGCCCACTTAGTC AACGTTCATGGTAAGGTCTTGGACCGTAAGTCTATGGGTGAGGAT TTATTCTGGGCTTTGAGAGGTGGTGGTGCTGAATCTTTCGGTATT ATCGTCGCTTGGAAGATTAGATTAGTTGCTGTTCCAAAGTCTACT ATGTTCTCTGTTAAGAAGATCATGGAAATTCACGAGTTGGTTAAA TTAGTTAACAAATGGCAAAACATTGCCTACAAGTACGATAAAGAT TTGTTATTAATGACTCACTTTATCACTAGAAACATTACTGATAAC CAAGGTAAGAATAAGACTGCCATTCACACTTACTTCTCTTCTGTT TTCTTGGGTGGTGTTGATTCCTTGGTCGATTTGATGAACAAGTCT TTTCCAGAATTAGGTATTAAGAAGACCGATTGTCGTCAATTATCT TGGATTGATACCATTATTTTTTACTCCGGTGTTGTCAACTACGAC ACTGATAATTTTAATAAGGAGATTTTGTTAGATAGATCTGCTGGT CAAAATGGTGCCTTTAAAATCAAATTGGACTACGTTAAGAAGCCT ATTCCAGAATCCGTC TTTGTTCAAATTTTGGAGAAGTTATACGAAGAAGATATTGGTGCT GGTATGTACGCCTTGTATCCATATGGTGGTATTATGGATGAAATT TCTGAATCCGCCATCCCTTTCCCTCATCGTGCTGGTATCTTATAC GAGTTGTGGTACATCTGTTCTTGGGAAAAGCAAGAAGATAATGAA AAGCATTTGAACTGGATCCGTAACATCTATAACTTCATGACTCCA TACGTTTCCAAAAACCCTAGATTGGCTTACTTAAATTACAGAGAC TTAGATATTGGTATTAACGACCCTAAGAACCCAAACAATTACACT CAAGCTAGAATCTGGGGTGAAAAGTACTTCGGTAAGAATTTCGAC AGATTAGTTAAGGTCAAGACTTTAGTTGACCCAAATAACTTCTTC AGAAACGAACAATCTATCCCACCATTGCCTAGACATAGACACTAG |
| SEQ ID NO: 78<br>CBDA Synthase,<br>Q55P<br>variant<br>Artificial Sequence | MKCSTFSFWFVCKIIFFFFSFNIQTSIANPRENFLKCFSQYIPNN ATNLKLVYTPNNPLYMSVLNSTIHNLRFTSDTTPKPLVIVTPSHV SHIQGTILCSKKVGLQIRTRSGGHDSEGMSYISQVPFVIVDLRNM RSIKIDVHSQTAWVEAGATLGEVYYWVNEKNENLSLAAGYCPTVC AGGHFGGGGYGPLMRNYGLAADNIIDAHLVNVHGKVLDRKSMGED LFWALRGGGAESFGIIVAWKIRLVAWKSTMFSVKKIMEIHELVKJ LVNKWQNIAYKYDKDLLLMTHFITRNITDNQGKNKTAIHTYFSSV FLGGVDSLVDLMNKSFPELGIKKTDCRQLSWIDTIIFYSGVVNYD TDNFNKEILLDRSAGQNGAFKIKLDYVKKPIPESWVQILEKLYEE DIGAGMYALYPYGGIMDEISESAIPFPHRAGILYELWYICSWEKQ EDNEKHLNWIRNIYNFMTPYVSKNPRLAYLNYRDLDIGINDPKNP NNYTQARIWGEKYFGKNFDRLVKVKTLVDPNNFFRNEQSIPPLPR HRH* |
| SEQ ID NO: 79<br>CBDA Synthase,<br>N56E<br>variant<br>Artificial Sequence<br>Codon optimized | ATGAAATGCTCCACTTTCTCTTTCTGGTTCGTTTGTAAGATTATC TTCTTCTTCTTTTCTTTCAACATCCAAACTTCCATTGCCAACCCT CGTGAGAACTTCTTGAAATGTTTTTCTCAATATATCCCAAATAAC GCTACTAACTTGAAGTTAGTCTATACTCAAgaaAACCCATTATAT ATGTCTGTCTTAAACTCTACCATTCACAACTTACGTTTCACTTCT GATACTACTCCAAAACCTTTGGTCATCGTCACCCCATCCCACGTT TCTCACATCCAAGGTACCATCTTGTGTTCCAAAAAGGTTGGTTTA CAAATCCGTACTAGATCCGGTGGTCATGACTCCGAAGGTATGTCT TACATTTCCCAAGTCCCTTTCGTCATCGTCGACTTAAGAAATATG CGTTCCATCAAGATTGATGTCCATTCCCAAACTGCTTGGGTTGAA GCCGGTGCCACTTTAGGTGAAGTCTATTACTGGGTTAACGAGAAG AATGAGAACTTATCTTTGGCTGCCGGTTACTGTCCAACTGTTTGT GCTGGTGGTCATTTCGGTGGTGGTGGTTACGGTCCATTAATGCGT AACTACGGTTTGGCTGCCGATAACATCATTGATGCCCACTTAGTC AACGTTCATGGTAAGGTCTTGGACCGTAAGTCTATGGGTGAGGAT TTATTCTGGGCTTTGAGAGGTGGTGGTGCTGAATCTTTCGGTATT ATCGTCGCTTGGAAGATTAGATTAGTTGCTGTTCCAAAGTCTACT ATGTTCTCTGTTAAGAAGATCATGGAAATTCACGAGTTGGTTAAA TTAGTTAACAAATGGCAAAACATTGCCTACAAGTACGATAAAGAT TTGTTATTAATGACTCACTTTATCACTAGAAACATTACTGATAAC CAAGGTAAGAATAAGACTGCCATTCACACTTACTTCTCTTCTGTT TTCTTGGGTGGTGTTGATTCCTTGGTCGATTTGATGAACAAGTCT TTTCCAGAATTAGGTATTAAGAAGACCGATTGTCGTCAATTATCT TGGATTGATACCATTATTTTTTACTCCGGTGTTGTCAACTACGAC ACTGATAATTTTAATAAGGAGATTTTGTTAGATAGATCTGCTGGT CAAAATGGTGCCTTTAAAATCAAATTGGACTACGTTAAGAAGCCT ATTCCAGAATCCGTCTTTGTTCAAATTTTGGAGAAGTTATACGAA GAAGATATTGGTGCTGGTATGTACGCCTTGTATCCATATGGTGGT ATTATGGATGAAATTTCTGAATCCGCCATCCCTTTCCCTCATCGT GCTGGTATCTTATACGAGTTGTGGTACATCTGTTCTTGGGAAAAG CAAGAAGATAATGAAAAGCATTTGAACTGGATCCGTAACATCTAT AACTTCATGACTCCATACGTTTCCAAAAACCCTAGATTGGCTTAC TTAAATTACAGAGACTTAGATATTGGTATTAACGACCCTAAGAAC CCAAACAATTACACTCAAGCTAGAATCTGGGGTGAAAAGTACTTC GGTAAGAATTTCGACAGATTAGTTAAGGTCAAGACTTTAGTTGAC |

TABLE 1-continued

| Amino acid and nucleotide sequences of the disclosure | |
|---|---|
| | CCAAATAACTTCTTCAGAAACGAACAATCTATCCCACCATTGCCT AGACATAGACACTAG |
| SEQ ID NO: 80 CBDA Synthase, N56E variant Artificial Sequence | MKCSTFSFWFVCKIIFFFFSFNIQTSIANPRENFLKCFSQYIPNN ATNLKLVYTQENPLYMSVLNSTIHNLRFTSDTTPKPLVIVTPSHV SHIQGTILCSKKVGLQTRTRSGGHDSEGMSYISQVPFVIVDLRNM RSIKIDVHSQTAWVEAGATLGEVYYWVNEKNENLSLAAGYCPTVC AGGHFGGGGYGPLMRNYGLAADNIIDAHLVNVHGKVLDRKSMGED LFWALRGGGAESFGIIVAWKIRLVAVPKSTMFSVKKIMEIHELVK LVNKWQNIAYKYDKDLLLMTHFITRNITDNQGKNKTAIHTYFSSV FLGGVDSLVDLMNKSFPELGIKKTDCRQLSWIDTIIFYSGWNYDT DNFNKEILLDRSAGQNGAFKKLDYVKKPIPESVFVQILEKLYEED IGAGMYALYPYGGIMDEISESAIPFPHRAGILYELWYICSWEKQE DNEKHLNWIRNIYNFMTPYVSKNPRLAYLNYRDLDIGINDPKNPN NYTQARIWGEKYFGKNFDRLVKVKTLVDPNNFFRNEQSIPPLPRH RH* |
| SEQ ID NO: 81 CBDA Synthase, N57D variant Artificial Sequence Codon optimized | ATGAAATGCTCCACTTTCTCTTTCTGGTTCGTTTGTAAGATTATC TTCTTCTTCTTTTCTTTCAACATCCAAACTTCCATTGCCAACCCT CGTGAGAACTTCTTGAAATGTTTTTCTCAATATATCCCAAATAAC GCTACTAACTTGAAGTTAGTCTATACTCAAAACgatCCATTATAT ATGTCTGTCTTAAACTCTACCATTCACAACTTACGTTTCACTTCT GATACTACTCCAAAACCTTTGGTCATCGTCACCCCATCCCACGTT TCTCACATCCAAGGTACCATCTTGTGTTCCAAAAAGGTTGGTTTA CAAATCCGTACTAGATCCGGTGGTCATGACTCCGAAGGTATGTCT TACATTTCCCAAGTCCCTTTCGTCATCGTCGACTTAAGAAATATG CGTTCCATCAAGATTGATGTCCATTCCCAAACTGCTTGGGTTGAA GCCGGTGCCACTTTAGGTGAAGTCTATTACTGGGTTAACGAGAAG AATGAGAACTTATCTTTGGCTGCCGGTTACTGTCCAACTGTTTGT GCTGGTGGTCATTTCGGTGGTGGTGGTTACGGTCCATTAATGCGT AACTACGGTTTGGCTGCCGATAACATCATTGATGCCCACTTAGTC AACGTTCATGGTAAGGTCTTGGACCGTAAGTCTATGGGTGAGGAT TTATTCTGGGCTTTGAGAGGTGGTGGTGCTGAATCTTTCGGTATT ATCGTCGCTTGGAAGATTAGATTAGTTGCTGTTCCAAAGTCTACT ATGTTCTCTGTTAAGAAGATCATGGAAATTCACGAGTTGGTTAAA TTAGTTAACAAATGGCAAAACATTGCCTACAAGTACGATAAAGAT TTGTTATTAATGACTCACTTTATCACTAGAAACATTACTGATAAC CAAGGTAAGAATAAGACTGCCATTCACACTTACTTCTCTTCTGTT TTCTTGGGTGGTGTTGATTCCTTGGTCGATTTGATGAACAAGTCT TTTCCAGAATTAGGTATTAAGAAGACCGATTGTCGTCAATTATCT TGGATTGATACCATTATTTTTTACTCCGGTGTTGTCAACTACGAC ACTGATAATTTTAATAAGGAGATTTTGTTAGATAGATCTGCTGGT CAAAATGGTGCCTTTAAAATCAAATTGGACTACGTTAAGAAGCCT ATTCCAGAATCCGTCTTTGTTCAAATTTTGGAGAAGTTATACGAA GAAGATATTGGTGCTGGTATGTACGCCTTGTATCCATATGGTGGT ATTATGGATGAAATTTCTGAATCCGCCATCCCTTTCCCTCATCGT GCTGGTATCTTATACGAGTTGTGGTACATCTGTTCTTGGGAAAAG CAAGAAGATAATGAAAAGCATTTGAACTGGATCCGTAACATCTAT AACTTCATGACTCCATACGTTTCCAAAAACCCTAGATTGGCTTAC TTAAATTACAGAGACTTAGATATTGGTATTAACGACCCTAAGAAC CCAAACAATTACACTCAAGCTAGAATCTGGGGTGAAAAGTACTTC GGTAAGAATTTCGACAGATTAGTTAAGGTCAAGACTTTAGTTGAC CCAAATAACTTCTTCAGAAACGAACAATCTATCCCACCATTGCCT AGACATAGACACTAG |
| SEQ ID NO: 82 CBDA Synthase, N57D variant Artificial Sequence | MKCSTFSFWFVCKIIFFFFSFNIQTSIANPRENFLKCFSQYIPNN ATNLKLVYTQNDPLYMSVLNSTIHNLRFTSDTTPKPLVIVTPSHV SHIQGTILCSKKVGLQIRTRSGGHDSEGMSYISQVPFVIVDLRNM RSIKIDVHSQTAWVEAGATLGEVYYWVNEKNENLSLAAGYCPTVC AGGHFGGGGYGPLMRNYGLAADNIIDAHLVNVHGKVLDRKSMGED LFWALRGGGAESFGIIVAWKIRLVAVPKSTMFSVKKIMEIHELVK LVNKWQNIAYKYDKDLLLMTHFITRNITDNQGKNKTAIHTYFSSV FLGGVDSLVDLMNKSFPELGIKKTDCRQLSWIDTIIFYSGWNYDT DNFNKEILLDRSAGQNGAFKIKLDYVKKPIPESVFVQILEKLYEE DIGAGMYALYPYGGIMDEISESAIPFPHRAGILYELWYICSWEKQ EDNEKHLNWIRNIYNFMTPYVSKNPRLAYLNYRDLDIGINDPKNP NNYTQARIWGEKYFGKNFDRLVKVKTLVDPNNFFRNEQSIPPLPR HRH* |
| SEQ ID NO: 83 CBDA Synthase, N57E variant Artificial Sequence Codon optimized | ATGAAATGCTCCACTTTCTCTTTCTGGTTCGTTTGTAAGATTATC TTCTTCTTCTTTTCTTTCAACATCCAAACTTCCATTGCCAACCCT CGTGAGAACTTCTTGAAATGTTTTTCTCAATATATCCCAAATAAC GCTACTAACTTGAAGTTAGTCTATACTCAAAACgaaCCATTATAT ATGTCTGTCTTAAACTCTACCATTCACAACTTACGTTTCACTTCT GATACTACTCCAAAACCTTTGGTCATCGTCACCCCATCCCACGTT TCTCACATCCAAGGTACCATCTTGTGTTCCAAAAAGGTTGGTTTA CAAATCCGTACTAGATCCGGTGGTCATGACTCCGAAGGTATGTCT TACATTTCCCAAGTCCCTTTCGTCATCGTCGACTTAAGAAATATG |

TABLE 1-continued

| Amino acid and nucleotide sequences of the disclosure | |
|---|---|
| | CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGC<br>AAAACATTGCCTACAAGTACGATAAAGATTTGTTATTAATGACTC<br>ACTTTATCACTAGAAACATTACTGATAACCAAGGTAAGAATAAGA<br>CTGCCATTCACACTTACTTCTCTTCTGTTTTCTTGGGTGGTGTTG<br>ATTCCTTGGTCGATTTGATGAACAAGTCTTTTCCAGAATTAGGTA<br>TTAAGAAGACCGATTGTCGTCAATTATCTTGGATTGATACCATTA<br>TTTTTTACTCCGGTGTTGTCAACTACGACACTGATAATTTTAATA<br>AGGAGATTTTGTTAGATAGATCTGCTGGTCAAAATGGTGCCTTTA<br>AAATCAAATTGGACTACGTTAAGAAGCCTATTCCAGAATCCGTCT<br>TTGTTCAAATTTTGGAGAAGTTATACGAAGAAGATATTGGTGCTG<br>GTATGTACGCCTTGTATCCATATGGTGGTATTATGGATGAAATTT<br>CTGAATCCGCCATCCCTTTCCCTCATCGTGCTGGTATCTTATACG<br>AGTTGTGGTACATCTGTTCTTGGGAAAAGCAAGAAGATAATGAAA<br>AGCATTTGAACTGGATCCGTAACATCTATAACTTCATGACTCCAT<br>ACGTTTCCAAAAACCCTAGATTGGCTTACTTAAATTACAGAGACT<br>TAGATATTGGTATTAACGACCCTAAGAACCCAAACAATTACACTC<br>AAGCTAGAATCTGGGGTGAAAAGTACTTCGGTAAGAATTTCGACA<br>GATTAGTTAAGGTCAAGACTTTAGTTGACCCAAATAACTTCTTCA<br>GAAACGAACAATCTATCCCACCATTGCCTAGACATAGACACTAG |
| SEQ ID NO: 84<br>CBDA Synthase, N57E variant<br>Artificial Sequence | MKCSTFSFWFVCKIIFFFFSFNIQTSIANPRENFLKCFSQYIPNN<br>ATNLKLVYTQNEPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKIKLDYVKKPIPESVFVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP<br>NNYTQARIWGEKYFGKNFDRLVKVKTLVDPNNFFRNEQSIPPLPR<br>HRH* |
| SEQ ID NO: 85<br>CBDA Synthase, L59E variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCAgaaTAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA |

TABLE 1-continued

| Amino acid and nucleotide sequences of the disclosure | |
|---|---|
| | ACTTCTTCAGAAACGAACAATCTATCCCACCATTGCCTAGACATA GACACTAG |
| SEQ ID NO: 86 CBDA Synthase, L59E variant Artificial Sequence | MKCSTFSFWFVCKIIFFFFSFNIQTSIANPRENFLKCFSQYIPNN ATNLKLVYTQNNPEYMSVLNSTIHNLRFTSDTTPKPLVIVTPSHV SHIQGTILCSKKVGLQIRTRSGGHDSEGMSYISQVPFVIVDLRNM RSIKIDVHSQTAWVEAGATLGEVYYWVNEKNENLSLAAGYCPTVC AGGHFGGGGYGPLMRNYGLAADNIIDAHLVNVHGKVLDRKSMGED LFWALRGGGAESFGIIVAWKIRLVAWKSTMFSVKKIMEIHELVKL VNKWQNIAYKYDKDLLLMTHFITRNITDNQGKNKTAIHTYFSSWL GGVDSLVDLMNKSFPELGIKKTDCRQLSWIDTIIFYSGWNYDTDN FNKEILLDRSAGQNGAFKIKLDYVKKPIPESVFVQILEKLYEEDI GAGMYALYPYGGIMDEISESAIPFPHRAGILYELWYICSWEKQED NEKHLNWIRNIYNFMTPYVSKNPRLAYLNYRDLDIGINDPKNPNN YTQARIWGEKYFGKNFDRLVKVKTLVDPNNFFRNEQSIPPLPRHR H* |
| SEQ ID NO: 87 CBDA Synthase, M61H variant Artificial Sequence Codon optimized | ATGAAATGCTCCACTTTCTCTTTCTGGTTCGTTTGTAAGATTATC TTCTTCTTCTTTTCTTTCAACATCCAAACTTCCATTGCCAACCCT CGTGAGAACTTCTTGAAATGTTTTTCTCAATATATCCCAAATAAC GCTACTAACTTGAAGTTAGTCTATACTCAAAACAACCCATTATAT catTCTGTCTTAAACTCTACCATTCACAACTTACGTTTCACTTCT GATACTACTCCAAAACCTTTGGTCATCGTCACCCCATCCCACGTT TCTCACATCCAAGGTACCATCTTGTGTTCCAAAAAGGTTGGTTTA CAAATCCGTACTAGATCCGGTGGTCATGACTCCGAAGGTATGTCT TACATTTCCCAAGTCCCTTTCGTCATCGTCGACTTAAGAAATATG CGTTCCATCAAGATTGATGTCCATTCCCAAACTGCTTGGGTTGAA GCCGGTGCCACTTTAGGTGAAGTCTATTACTGGGTTAACGAGAAG AATGAGAACTTATCTTTGGCTGCCGGTTACTGTCCAACTGTTTGT GCTGGTGGTCATTTCGGTGGTGGTGGTTACGGTCCATTAATGCGT AACTACGGTTTGGCTGCCGATAACATCATTGATGCCCACTTAGTC AACGTTCATGGTAAGGTCTTGGACCGTAAGTCTATGGGTGAGGAT TTATTCTGGGCTTTGAGAGGTGGTGGTGCTGAATCTTTCGGTATT ATCGTCGCTTGGAAGATTAGATTAGTTGCTGTTCCAAAGTCTACT ATGTTCTCTGTTAAGAAGATCATGGAAATTCACGAGTTGGTTAAA TTAGTTAACAAATGGCAAAACATTGCCTACAAGTACGATAAAGAT TTGTTATTAATGACTCACTTTATCACTAGAAACATTACTGATAAC CAAGGTAAGAATAAGACTGCCATTCACACTTACTTCTCTTCTGTT TTCTTGGGTGGTGTTGATTCCTTGGTCGATTTGATGAACAAGTCT TTTCCAGAATTAGGTATTAAGAAGACCGATTGTCGTCAATTGATA ATTTTAATAAGGAGATTTTGTTAGATAGATCTGCTGGTCAAAATG GTGCCTTTAAAATCAAATTGGACTACGTTAAGAAGCCTATTCCAG AATCCGTCTTTGTTCAAATTTTGGAGAAGTTATACGAAGAAGATA TTGGTGCTGGTATGTACGCCTTGTATCCATATGGTGGTATTATGG ATGAAATTTCTGAATCCGCCATCCCTTTCCCTCATCGTGCTGGTA TCTTATACGAGTTGTGGTACATCTGTTCTTGGGAAAAGCAAGAAG ATAATGAAAAGCATTTGAACTGGATCCGTAACATCTATAACTTCA TGACTCCATACGTTTCCAAAAACCCTAGATTGGCTTACTTAAATT ACAGAGACTTAGATATTGGTATTAACGACCCTAAGAACCCAAACA ATTACACTCAAGCTAGAATCTGGGGTGAAAAGTACTTCGGTAAGA ATTTCGACAGATTAGTTAAGGTCAAGACTTTAGTTGACCCAAATA ACTTCTTCAGAAACGAACAATCTATCCCACCATTGCCTAGACATA GACACTAG |
| SEQ ID NO: 88 CBDA Synthase, M61H variant Artificial Sequence | MKCSTFSFWFVCKIIFFFFSFNIQTSIANPRENFLKCFSQYIPNN ATNLKLVYTQNNPLYHSVLNSTIHNLRFTSDTTPKPLVIVTPSHV SHIQGTILCSKKVGLQIRTRSGGHDSEGMSYISQVPFVIVDLRNM RSIKIDVHSQTAWVEAGATLGEVYYWVNEKNENLSLAAGYCPTVC AGGHFGGGGYGPLMRNYGLAADNIIDAHLVNVHGKVLDRKSMGED LFWALRGGGAESFGIIVAWKIRLVAVPKSTMFSVKKIMEIHELVK LVNKWQNIAYKYDKDLLLMTHFITRNITDNQGKNKTAIHTYFSSV FLGGVDSLVDLMNKSFPELGIKKTDCRQLSWIDTIIFYSGVVNYD TDNFNKEILLDRSAGQNGAFKIKLDYVKKPIPESVFVQILEKLYE EDIGAGMYALYPYGGIMDEISESATPFPHRAGILYELWYICSWEK QEDNEKHLNWIRNIYNFMTPYVSKNPRLAYLNYRDLDIGINDPKN PNNYTQARIWGEKYFGKNFDRLVKVKTLVDPNNFFRNEQSIPPLP RHRH* |
| SEQ ID NO: 89 CBDA Synthase, M61S variant Artificial Sequence Codon optimized | ATGAAATGCTCCACTTTCTCTTTCTGGTTCGTTTGTAAGATTATC TTCTTCTTCTTTTCTTTCAACATCCAAACTTCCATTGCCAACCCT CGTGAGAACTTCTTGAAATGTTTTTCTCAATATATCCCAAATAAC GCTACTAACTTGAAGTTAGTCTATACTCAAAACAACCCATTATAT tctTCTGTCTTAAACTCTACCATTCACAACTTACGTTTCACTTCT GATACTACTCCAAAACCTTTGGTCATCGTCACCCCATCCCACGTT TCTCACATCCAAGGTACCATCTTGTGTTCCAAAAAGGTTGGTTTA CAAATCCGTACTAGATCCGGTGGTCATGACTCCGAAGGTATGTCT TACATTTCCCAAGTCCCTTTCGTCATCGTCGACTTAAGAAATATG CGTTCCATCAAGATTGATGTCCATTCCCAAACTGCTTGGGTTGAA |

TABLE 1-continued

| Amino acid and nucleotide sequences of the disclosure | |
|---|---|
| | GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 90<br>CBDA Synthase, M61S<br>variant<br>Artificial Sequence | MKCSTFSFWFVCKIIFFFFSFNIQTSIANPRENFLKCFSQYIPNN<br>ATNLKLVYTQNNPLYSSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAWKSTMFSVKKIMEIHELVKL<br>VNKWQNIAYKYDKDLLLMTHFITRNITDNQGKNKTAIHTYFSSVF<br>LGGVDSLVDLMNKSFPELGIKKTDCRQLSWIDTHFYSGWNYDTDN<br>FNKEILLDRSAGQNGAFKIKLDYVKKPIPESVFVQILEKLYEEDI<br>GAGMYALYPYGGIMDEISESAIPFPHRAGILYELWYICSWEKQED<br>NEKHLNWIRNIYNFMTPYVSKNPRLAYLNYRDLDIGINDPKNPNN<br>YTQARIWGEKYFGKNFDRLVKVKTLVDPNNFFRNEQSIPPLPRHR<br>H* |
| SEQ ID NO: 91<br>CBDA Synthase,<br>M61W variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>tggTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |

TABLE 1-continued

| Amino acid and nucleotide sequences of the disclosure | |
|---|---|
| SEQ ID NO: 92<br>CBDA Synthase,<br>M61W variant<br>Artificial Sequence | MKCSTFSFWFVCKIIFFFFSFNIQTSIANPRENFLKCFSQYIPNN<br>ATNLKLVYTQNNPLYWSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGVVNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>RHRH* |
| SEQ ID NO: 93<br>CBDA Synthase, S62N<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGaatGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 94<br>CBDA Synthase, S62N<br>variant<br>Artificial Sequence | MKCSTFSFWFVCKIIFFFFSFNIQTSIANPRENFLKCFSQYIPNN<br>ATNLKLVYTQNNPLYMNVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKKLDYVKKPIPESVFVQILEKLYEED<br>IGAGMYALYPYGGIMDEISESAIPFPHRAGILYELWYICSWEKQE<br>DNEKHLNWIRNIYNFMTPYVSKNPRLAYLNYRDLDIGINDPKNPN<br>NYTQARIWGEKYFGKNFDRLVKVKTLVDPNNFFRNEQSIPPLPRH<br>RH* |
| SEQ ID NO: 95 | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTG |
| CBDA Synthase,<br>S62Q<br>variant<br>Artificial Sequence<br>Codon optimized | AAATGTTTTTCTCAATATATCCCAAATAACGCTACTAACTTGAAG<br>TTAGTCTATACTCAAAACAACCCATTATATATGcaaGTCTTAAAC<br>TCTACCATTCACAACTTACGTTTCACTTCTGATACTACTCCAAAA<br>CCTTTGGTCATCGTCACCCCATCCCACGTTTCTCACATCCAAGGT<br>ACCATCTTGTGTTCCAAAAAGGTTGGTTTACAAATCCGTACTAGA<br>TCCGGTGGTCATGACTCCGAAGGTATGTCTTACATTTCCCAAGTC<br>CCTTTCGTCATCGTCGACTTAAGAAATATGCGTTCCATCAAGATT<br>GATGTCCATTCCCAAACTGCTTGGGTTGAAGCCGGTGCCACTTTA |

TABLE 1-continued

| Amino acid and nucleotide sequences of the disclosure | |
|---|---|
| | GGTGAAGTCTATTACTGGGTTAACGAGAAGAATGAGAACTTATCT<br>TTGGCTGCCGGTTACTGTCCAACTGTTTGTGCTGGTGGTCATTTC<br>GGTGGTGGTGGTTACGGTCCATTAATGCGTAACTACGGTTTGGCT<br>GCCGATAACATCATTGATGCCCACTTAGTCAACGTTCATGGTAAG<br>GTCTTGGACCGTAAGTCTATGGGTGAGGATTTATTCTGGGCTTTG<br>AGAGGTGGTGGTGCTGAATCTTTCGGTATTATCGTCGCTTGGAAG<br>ATTAGATTAGTTGCTGTTCCAAAGTCTACTATGTTCTCTGTTAAG<br>AAGATCATGGAAATTCACGAGTTGGTTAAATTAGTTAACAAATGG<br>CAAAACATTGCCTACAAGTACGATAAAGATTTGTTATTAATGACT<br>CACTTTATCACTAGAAACATTACTGATAACCAAGGTAAGAATAAG<br>ACTGCCATTCACACTTACTTCTCTTCTGTTTTCTTGGGTGGTGTT<br>GATTCCTTGGTCGATTTGATGAACAAGTCTTTTCCAGAATTAGGT<br>ATTAAGAAGACCGATTGTCGTCAATTATCTTGGATTGATACCATT<br>ATTTTTTACTCCGGTGTTGTCAACTACGACACTGATAATTTTAAT<br>AAGGAGATTTTGTTAGATAGATCTGCTGGTCAAAATGGTGCCTTT<br>AAAATCAAATTGGACTACGTTAAGAAGCCTATTCCAGAATCCGTC<br>TTTGTTCAAATTTTGGAGAAGTTATACGAAGAAGATATTGGTGCT<br>GGTATGTACGCCTTGTATCCATATGGTGGTATTATGGATGAAATT<br>TCTGAATCCGCCATCCCTTTCCCTCATCGTGCTGGTATCTTATAC<br>GAGTTGTGGTACATCTGTTCTTGGGAAAAGCAAGAAGATAATGAA<br>AAGCATTTGAACTGGATCCGTAACATCTATAACTTCATGACTCCA<br>TACGTTTCCAAAAACCCTAGATTGGCTTACTTAAATTACAGAGAC<br>TTAGATATTGGTATTAACGACCCTAAGAACCCAAACAATTACACT<br>CAAGCTAGAATCTGGGGTGAAAAGTACTTCGGTAAGAATTTCGAC<br>AGATTAGTTAAGGTCAAGACTTTAGTTGACCCAAATAACTTCTTC<br>AGAAACGAACAATCTATCCCACCATTGCCTAGACATAGACACTAG |
| SEQ ID NO: 96<br>CBDA Synthase,<br>S62Q<br>variant<br>Artificial Sequence | MKCSTFSFWFVCKIIFFFFSFNIQTSIANPRENFLKCFSQYIPNN<br>ATNLKLVYTQNNPLYMQVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKIKLDYVKKPIPESVFVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP<br>NNYTQARIWGEKYFGKNFDRLVKVKTLVDPNNFFRNEQSIPPLPR<br>HRH* |
| SEQ ID NO: 97<br>CBDA Synthase,<br>V63M variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTatgTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |

TABLE 1-continued

| Amino acid and nucleotide sequences of the disclosure | |
|---|---|
| SEQ ID NO: 98<br>CBDA Synthase,<br>V63M variant<br>Artificial Sequence | MKCSTFSFWFVCKIIFFFFSFNIQTSIANPRENFLKCFSQYIPNN<br>ATNLKLVYTQNNPLYMSMLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSW<br>LGGVDSLVDLMNKSFPELGIKKTDCRQLSWIDTIIFYSGVVNYDT<br>DNFNKEILLDRSAGQNGAFKKLDYVKKPIPESVFVQILEKLYEED<br>IGAGMYALYPYGGIMDEISESAIPFPHRAGILYELWYICSWEKQE<br>DNEKHLNWIRNIYNFMTPYVSKNPRLAYLNYRDLDIGINDPKNPN<br>NYTQARIWGEKYFGKNFDRLVKVKTLVDPNNFFRNEQSIPPLPRH<br>RH* |
| SEQ ID NO: 99<br>CBDA Synthase, S66D<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACgatACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |
| SEQ ID NO: 100<br>CBDA Synthase, S66D<br>variant<br>Artificial Sequence | MKCSTFSFWFVCKIIFFFFSFNIQTSIANPRENFLKCFSQYIPNN<br>ATNLKLVYTQNNPLYMSVLNDTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGG<br>VDSLVDLMNKSFPELGIKKTDCRQLSWIDTIIFYSGWNYDTDNFN<br>KEILLDRSAGQNGAFKIKLDYVKKPIPESVFVQILEKLYEEDIGA<br>GMYALYPYGGIMDEISESAIPFPHRAGILYELWYICSWEKQEDNE<br>KHLNWIRNIYNFMTPYVSKNPRLAYLNYRDLDIGINDPKNPNNYT<br>QARIWGEKYFGKNFDRLVKVKTLVDPNNFFRNEQSIPPLPRHRH* |
| SEQ ID NO: 101<br>CBDA Synthase, L71A<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACgctCGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT |

TABLE 1-continued

| Amino acid and nucleotide sequences of the disclosure | |
|---|---|
| | AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |
| SEQ ID NO: 102<br>CBDA Synthase, L71A<br>variant<br>Artificial Sequence | MKCSTFSFWFVCKIIFFFFSFNIQTS1ANPRENFLKCFSQYIPNN<br>ATNLKLVYTQNNPLYMSVLNSTIHNARFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFG1IVAWKIRLVAVPKSTMFSVKKIMEIHELVK<br>LVNKWQNIAYKYDKDLLLMTHFITRN1TDNQGKNKTAIHTYFSSV<br>FLGGVDSLVDLMNKSFPELGIKKTDCRQLSW1DTIIFYSGVVNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>RHRH* |
| SEQ ID NO: 103<br>CBDA Synthase, L71H<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACcatCGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAG<br>GATTTATTCTGGGCTTTGAGAGGTGGTGGTGCTGAATCTTTCGGT<br>ATTATCGTCGCTTGGAAGATTAGATTAGTTGCTGTTCCAAAGTCT<br>ACTATGTTCTCTGTTAAGAAGATCATGGAAATTCACGAGTTGGTT<br>AAATTAGTTAACAAATGGCAAAACATTGCCTACAAGTACGATAAA<br>GATTTGTTATTAATGACTCACTTTATCACTAGAAACATTACTGAT<br>AACCAAGGTAAGAATAAGACTGCCATTCACACTTACTTCTCTTCT<br>GTTTTCTTGGGTGGTGTTGATTCCTTGGTCGATTTGATGAACAAG<br>TCTTTTCCAGAATTAGGTATTAAGAAGACCGATTGTCGTCAATTA<br>TCTTGGATTGATACCATTATTTTTTACTCCGGTGTTGTCAACTAC<br>GACACTGATAATTTTAATAAGGAGATTTTGTTAGATAGATCTGCT<br>GGTCAAAATGGTGCCTTTAAAATCAAATTGGACTACGTTAAGAAG<br>CCTATTCCAGAATCCGTCTTTGTTCAAATTTTGGAGAAGTTATAC<br>GAAGAAGATATTGGTGCTGGTATGTACGCCTTGTATCCATATGGT<br>GGTATTATGGATGAAATTTCTGAATCCGCCATCCCTTTCCCTCAT<br>CGTGCTGGTATCTTATACGAGTTGTGGTACATCTGTTCTTGGGAA<br>AAGCAAGAAGATAATGAAAAGCATTTGAACTGGATCCGTAACATC<br>TATAACTTCATGACTCCATACGTTTCCAAAAACCCTAGATTGGCT<br>TACTTAAATTACAGAGACTTAGATATTGGTATTAACGACCCTAAG<br>AACCCAAACAATTACACTCAAGCTAGAATCTGGGGTGAAAAGTAC<br>TTCGGTAAGAATTTCGACAGATTAGTTAAGGTCAAGACTTTAGTT<br>GACCCAAATAACTTCTTCAGAAACGAACAATCTATCCCACCATTG<br>CCTAGACATAGACACTAG |
| SEQ ID NO: 104<br>CBDA Synthase, L71H | MKCSTFSFWFVCKIIFFFFSFNIQTSIANPRENFLKCFSQYIPNN<br>ATNLKLVYTQNNPLYMSVLNSTIHNHRFTSDTTPKPLVIVTPSHV |

TABLE 1-continued

| Amino acid and nucleotide sequences of the disclosure | |
|---|---|
| variant<br>Artificial Sequence | SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGVVNYD<br>TDNFNKEILLDRSAGQNGAFKKLDYVKKPIPESVFVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP<br>NNYTQARIWGEKYFGKNFDRLVKVKTLVDPNNFFRNEQSIPPLPR<br>HRH* |
| SEQ ID NO: 105<br>CBDA Synthase, L71Q<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACcaaCGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |
| SEQ ID NO: 106<br>CBDA Synthase, L71Q<br>variant<br>Artificial Sequence | MKCSTFSFWFVCKIIFFFFSFNIQTSIANPRENFLKCFSQYIPNN<br>ATNLKLVYTQNNPLYMSVLNSTIHNQRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSW<br>LGGVDSLVDLMNKSFPELGIKKTDCRQLSWIDTHFYSGWNYDTDN<br>FNKEILLDRSAGQNGAFKKLDYVKKPIPESVFVQILEKLYEEDIG<br>AGMYALYPYGGIMDEISESAIPFPHRAGILYELWYICSWEKQEDN<br>EKHLNWIRNIYNFMTPYVSKNPRLAYLNYRDLDIGINDPKNPNNY<br>TQARIWGEKYFGKNFDRLVKVKTLVDPNNFFRNEQSIPPLPRHRH<br>* |
| SEQ ID NO: 107<br>CBDA Synthase, S75D<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTgat<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT |

TABLE 1-continued

| Amino acid and nucleotide sequences of the disclosure | |
|---|---|
| | TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |
| SEQ ID NO: 108<br>CBDA Synthase, S75D<br>variant<br>Artificial Sequence | MKCSTFSFWFVCKIIFFFFSFNIQTSIANPRENFLKCFSQYTPNN<br>ATNLKLVYTQNNPLYMSVLNSTIHNLRFTDDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGVVNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>RHRH* |
| SEQ ID NO: 109<br>CBDA Synthase, S75E<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTgaa<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 110<br>CBDA Synthase, S75E<br>variant<br>Artificial Sequence | MKCSTFSFWFVCKIIFFFFSFNIQTSIANPRENFLKCFSQYIPNN<br>ATNLKLVYTQNNPLYMSVLNSTIHNLRFTEDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC |

TABLE 1-continued

| Amino acid and nucleotide sequences of the disclosure | |
|---|---|
| | AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSW<br>LGGVDSLVDLMNKSFPELGIKKTDCRQLSWIDTIIFYSGWNYDTD<br>NFNKEILLDRSAGQNGAFKIKLDYVKKPIPESVFVQILEKLYEED<br>IGAGMYALYPYGGIMDEISESAIPFPHRAGILYELWYICSWEKQE<br>DNEKHLNWIRNIYNFMTPYVSKNPRLAYLNYRDLDIGINDPKNPN<br>NYTQARIWGEKYFGKNFDRLVKVKTLVDPNNFFRNEQSIPPLPRH<br>RH* |
| SEQ ID NO: 111<br>CBDA Synthase, I97V<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCgttTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTC<br>TTTGTTCAAATTTTGGAGAAGTTATACGAAGAAGATATTGGTGCT<br>GGTATGTACGCCTTGTATCCATATGGTGGTATTATGGATGAAATT<br>TCTGAATCCGCCATCCCTTTCCCTCATCGTGCTGGTATCTTATAC<br>GAGTTGTGGTACATCTGTTCTTGGGAAAAGCAAGAAGATAATGAA<br>AAGCATTTGAACTGGATCCGTAACATCTATAACTTCATGACTCCA<br>TACGTTTCCAAAAACCCTAGATTGGCTTACTTAAATTACAGAGAC<br>TTAGATATTGGTATTAACGACCCTAAGAACCCAAACAATTACACT<br>CAAGCTAGAATCTGGGGTGAAAAGTACTTCGGTAAGAATTTCGAC<br>AGATTAGTTAAGGTCAAGACTTTAGTTGACCCAAATAACTTCTTC<br>AGAAACGAACAATCTATCCCACCATTGCCTAGACATAGACACTAG |
| SEQ ID NO: 112<br>CBDA Synthase, I97V<br>variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTVLCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGVVNYD<br>TDNFNKEILLDRSAGQNGAFKIKLDYVKKPIPESWVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP<br>NNYTQARIWGEKYFGKNFDRLVKVKTLVDPNNFFRNEOSIPPLPR<br>HRH* |
| SEQ ID NO: 113<br>CBDA Synthase, L98V<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCgttTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT |

TABLE 1-continued

| Amino acid and nucleotide sequences of the disclosure | |
|---|---|
| | ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 114<br>CBDA Synthase, L98V<br>variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTIVCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKKLDYVKKPIPESVFVQILEKLYEED<br>IGAGMYALYPYGGIMDEISESAIPFPHRAGILYELWYICSWEKQE<br>DNEKHLNWIRNIYNFMTPYVSKNPRLAYLNYRDLDIGINDPKNPN<br>NYTQARIWGEKYFGKNFDRLVKVKTLVDPNNFFRNEQSIPPLPRH<br>RH* |
| SEQ ID NO: 115<br>CBDA Synthase,<br>SI00A variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTgctAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 116<br>CBDA Synthase,<br>SI00A variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCAKKVGLQIRTRSGGHDSEGMSYISQVPFVIVDLRNM<br>RSIKIDVHSQTAWVEAGATLGEVYYWVNEKNENLSLAAGYCPTVC |

TABLE 1-continued

| Amino acid and nucleotide sequences of the disclosure | |
|---|---|
| | AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKIKLDYVKKPIPESVFVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP<br>NNYTQARIWGEKYFGKNFDRLVKVKTLVDPNNFFRNEQSIPPLPR<br>HRH* |
| SEQ ID NO: 117<br>CBDA Synthase,<br>VI03 A variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGgctGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 118<br>CBDA Synthase,<br>VI03A variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKAGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKIKLDYVKKPIPESVFVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP<br>NNYTQARIWGEKYFGKNFDRLVKVKTLVDPNNFFRNEQSIPPLPR<br>HRH* |
| SEQ ID NO: 119<br>CBDA Synthase,<br>V103F variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGlttGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT |

TABLE 1-continued

| Amino acid and nucleotide sequences of the disclosure | |
|---|---|
| | ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |
| SEQ ID NO: 120<br>CBDA Synthase,<br>V103F variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKFGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKIKLDYVKKPIPESVFVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP<br>NNYTQARIWGEKYFGKNFDRLVKVKTLVDPNNFFRNEQSIPPLPR<br>HRH* |
| SEQ ID NO: 121<br>CBDA Synthase,<br>T109V variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTgttAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |
| SEQ ID NO: 122<br>CBDA Synthase,<br>T109V variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRVRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK |

TABLE 1-continued

| Amino acid and nucleotide sequences of the disclosure | |
|---|---|
| | LVNKWQNIAYKYDKDLLLMTHFITRNITDNQGKNKTAIHTYFSSV<br>FLGGVDSLVDLMNKSFPELGIKKTDCRQLSWIDTIIFYSGVVNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>RHRH* |
| SEQ ID NO: 123<br>CBDA Synthase,<br>Q124D variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCgatGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 124<br>CBDA Synthase,<br>Q124D variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISDVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTHFYSGWNYDTD<br>NFNKEILLDRSAGQNGAFKIKLDYVKKPIPESVFVQILEKLYEED<br>IGAGMYALYPYGGIMDEISESAIPFPHRAGILYELWYICSWEKQE<br>DNEKHLNWIRNIYNFMTPYVSKNPRLAYLNYRDLDIGINDPKNPN<br>NYTQARIWGEKYFGKNFDRLVKVKTLVDPNNFFRNEQSIPPLPRH<br>RH* |
| SEQ ID NO: 125<br>CBDA Synthase,<br>Q124E variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCgaaGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA |

TABLE 1-continued

| Amino acid and nucleotide sequences of the disclosure | |
|---|---|
| | TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |
| SEQ ID NO: 126<br>CBDA Synthase,<br>Q124E variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISEVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGVVNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>RHRH* |
| SEQ ID NO: 127<br>CBDA Synthase,<br>Q124N variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCaatGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 128<br>CBDA Synthase,<br>Q124N variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISNVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV |

TABLE 1-continued

| Amino acid and nucleotide sequences of the disclosure | |
|---|---|
| | FLGGVDSLVDLMNKSFPELGIKKTDCRQLSWIDTIIFYSGWNYDT<br>DNFNKEILLDRSAGQNGAFKKLDYVKKPIPESVFVQILEKLYEED<br>IGAGMYALYPYGGIMDEISESAIPFPHRAGILYELWYICSWEKQE<br>DNEKHLNWIRNIYNFMTPYVSKNPRLAYLNYRDLDIGINDPKNPN<br>NYTQARIWGEKYFGKNFDRLVKVKTLVDPNNFFRNEQSIPPLPRH<br>RH* |
| SEQ ID NO: 129<br>CBDA Synthase,<br>V125E variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAgaaCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 130<br>CBDA Synthase,<br>V123E variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQEPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKIKLDYVKKPIPESVFVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP<br>NNYTQARIWGEKYFGKNFDRLVKVKTLVDPNNFFRNEQSIPPLPR<br>HRH* |
| SEQ ID NO: 131<br>CBDA Synthase,<br>V125Q variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAcaaCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT |

TABLE 1-continued

| Amino acid and nucleotide sequences of the disclosure | |
|---|---|
| | TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |
| SEQ ID NO: 132<br>CBDA Synthase,<br>V125Q variant<br>Artificial Sequence | MKCSTFSFWFVCKIIFFFFSFNIQTSIANPRENFLKCFSQYTPNN<br>ATNLKLVYTQNNPLYMSVLNSTIHNLRFTSDTTPKPLVIVTPSHV<br>SHIQGTILCSKKVGLQIRTRSGGHDSEGMSYISQQPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGVVNYD<br>TDNFNKEILLDRSAGQNGAFKKLDYVKKPIPESVFVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP<br>NNYTQARIWGEKYFGKNFDRLVKVKTLVDPNNFFRNEQSIPPLPR<br>HRH* |
| SEQ ID NO: 133<br>CBDA Synthase, 1129V<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCgttGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |
| SEQ ID NO: 134<br>CBDA Synthase, 1129V<br>variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVVVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKIKLDYVKKPIPESVFVQILEKLYEE |

TABLE 1-continued

| Amino acid and nucleotide sequences of the disclosure | |
|---|---|
| | DIGAGMYALYPYGGIMDEISESAIPFPHRAGILYELWYICSWEKQ<br>EDNEKHLNWIRNIYNFMTPYVSKNPRLAYLNYRDLDIGINDPKNP<br>NNYTQARIWGEKYFGKNFDRLVKVKTLVDPNNFFRNEQSIPPLP<br>RHRH* |
| SEQ ID NO: 135<br>CBDA Synthase,<br>L132M variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACatgAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |
| SEQ ID NO: 136<br>CBDA Synthase,<br>L132M variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDMRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGVVNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>RHRH* |
| SEQ ID NO: 137<br>CBDA Synthase,<br>S137G variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTggtATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT |

TABLE 1-continued

| Amino acid and nucleotide sequences of the disclosure | |
|---|---|
| | TTTCCAGAATTAGGTATTAAGAAGACCGATTGTCGTCAATTATCT TGGATTGATACCATTATTTTTACTCCGGTGTTGTCAACTACGAC ACTGATAATTTTAATAAGGAGATTTTGTTAGATAGATCTGCTGGT CAAAATGGTGCCTTTAAAATCAAATTGGACTACGTTAAGAAGCCT ATTCCAGAATCCGTCTTTGTTCAAATTTTGGAGAAGTTATACGAA GAAGATATTGGTGCTGGTATGTACGCCTTGTATCCATATGGTGGT ATTATGGATGAAATTTCTGAATCCGCCATCCCTTTCCCTCATCGT GCTGGTATCTTATACGAGTTGTGGTACATCTGTTCTTGGGAAAAG CAAGAAGATAATGAAAAGCATTTGAACTGGATCCGTAACATCTAT AACTTCATGACTCCATACGTTTCCAAAAACCCTAGATTGGCTTAC TTAAATTACAGAGACTTAGATATTGGTATTAACGACCCTAAGAAC CCAAACAATTACACTCAAGCTAGAATCTGGGGTGAAAAGTACTTC GGTAAGAATTTCGACAGATTAGTTAAGGTCAAGACTTTAGTTGAC CCAAATAACTTCTTCAGAAACGAACAATCTATCCCACCATTGCCT AGACATAGACACTAG |
| SEQ ID NO: 138<br>CBDA Synthase,<br>S137G variant<br>Artificial Sequence | MKCSTFSFWFVCKIIFFFFSFNIQTSIANPRENFLKCFSQYIPNN ATNLKLVYTQNNPLYMSVLNSTIHNLRFTSDTTPKPLVIVTPSHV SHIQGTILCSKKVGLQIRTRSGGHDSEGMSYISQVPFVIVDLRNM RGIKIDVHSQTAWVEAGATLGEVYYWVNEKNENLSLAAGYCPTVC AGGHFGGGGYGPLMRNYGLAADNIIDAHLVNVHGKVLDRKSMGED LFWALRGGGAESFGIIVAWKIRLVAVPKSTMFSVKKIMEIHELVK LVNKWQNIAYKYDKDLLLMTHFITRNITDNQGKNKTAIHTYFSSV FLGGVDSLVDLMNKSFPELGIKKTDCRQLSWIDTIIFYSGVVNYD TDNFNKEILLDRSAGQNGAFKKLDYVKKPIPESVFVQILEKLYEE DIGAGMYALYPYGGIMDEISESAIPFPHRAGILYELWYICSWEKQ EDNEKHLNWIRNIYNFMTPYVSKNPRLAYLNYRDLDIGINDPKNP NNYTQARIWGEKYFGKNFDRLVKVKTLVDPNNFFRNEQSIPPLPR HRH* |
| SEQ ID NO: 139<br>CBDA Synthase,<br>H143D variant<br>Artificial Sequence<br>Codon optimized | ATGAAATGCTCCACTTTCTCTTTCTGGTTCGTTTGTAAGATTATC TTCTTCTTCTTTTCTTTCAACATCCAAACTTCCATTGCCAACCCT CGTGAGAACTTCTTGAAATGTTTTTCTCAATATATCCCAAATAAC GCTACTAACTTGAAGTTAGTCTATACTCAAAACAACCCATTATAT ATGTCTGTCTTAAACTCTACCATTCACAACTTACGTTTCACTTCT GATACTACTCCAAAACCTTTGGTCATCGTCACCCCATCCCACGTT TCTCACATCCAAGGTACCATCTTGTGTTCCAAAAAGGTTGGTTTA CAAATCCGTACTAGATCCGGTGGTCATGACTCCGAAGGTATGTCT TACATTTCCCAAGTCCCTTTCGTCATCGTCGACTTAAGAAATATG CGTTCCATCAAGATTGATGTCgatTCCCAAACTGCTTGGGTTGAA GCCGGTGCCACTTTAGGTGAAGTCTATTACTGGGTTAACGAGAAG AATGAGAACTTATCTTTGGCTGCCGGTTACTGTCCAACTGTTTGT GCTGGTGGTCATTTCGGTGGTGGTGGTTACGGTCCATTAATGCGT AACTACGGTTTGGCTGCCGATAACATCATTGATGCCCACTTAGTC AACGTTCATGGTAAGGTCTTGGACCGTAAGTCTATGGGTGAGGAT TTATTCTGGGCTTTGAGAGGTGGTGGTGCTGAATCTTTCGGTATT ATCGTCGCTTGGAAGATTAGATTAGTTGCTGTTCCAAAGTCTACT ATGTTCTCTGTTAAGAAGATCATGGAAATTCACGAGTTGGTTAAA TTAGTTAACAAATGGCAAAACATTGCCTACAAGTACGATAAAGAT TTGTTATTAATGACTCACTTTATCACTAGAAACATTACTGATAAC CAAGGTAAGAATAAGACTGCCATTCACACTTACTTCTCTTCTGTT TTCTTGGGTGGTGTTGATTCCTTGGTCGATTTGATGAACAAGTCT TTTCCAGAATTAGGTATTAAGAAGACCGATTGTCGTCAATTGATA ATTTTAATAAGGAGATTTTGTTAGATAGATCTGCTGGTCAAAATG GTGCCTTTAAAATCAAATTGGACTACGTTAAGAAGCCTATTCCAG AATCCGTCTTTGTTCAAATTTTGGAGAAGTTATACGAAGAAGATA TTGGTGCTGGTATGTACGCCTTGTATCCATATGGTGGTATTATGG ATGAAATTTCTGAATCCGCCATCCCTTTCCCTCATCGTGCTGGTA TCTTATACGAGTTGTGGTACATCTGTTCTTGGGAAAAGCAAGAAG ATAATGAAAAGCATTTGAACTGGATCCGTAACATCTATAACTTCA TGACTCCATACGTTTCCAAAAACCCTAGATTGGCTTACTTAAATT ACAGAGACTTAGATATTGGTATTAACGACCCTAAGAACCCAAACA ATTACACTCAAGCTAGAATCTGGGGTGAAAAGTACTTCGGTAAGA ATTTC GACAGATTAGTTAAGGTCAAGACTTTAGTTGACCCAAATAACTTC TTCAGAAACGAACAATCTATCCCACCATTGCCTAGACATAGACAC TAG |
| SEQ ID NO: 140<br>CBDA Synthase,<br>H143D variant<br>Artificial Sequence | MKCSTFSFWFVCKIIFFFFSFNIQTSIANPRENFLKCFSQYIPNN ATNLKLVYTQNNPLYMSVLNSTIHNLRFTSDTTPKPLVIVTPSHV SHIQGTILCSKKVGLQIRTRSGGHDSEGMSYISQVPFVIVDLRNM RSIKIDVDSQTAWVEAGATLGEVYYWVNEKNENLSLAAGYCPTVC AGGHFGGGGYGPLMRNYGLAADNIIDAHLVNVHGKVLDRKSMGED LFWALRGGGAESFGIIVAWKIRLVAVPKSTMFSVKKIMEIHELVK LVNKWQNIAYKYDKDLLLMTHFITRNITDNQGKNKTAIHTYFSSV FLGGVDSLVDLMNKSFPELGIKKTDCRQLSWIDTIIFYSGWNYDT DNFNKEILLDRSAGQNGAFKKLDYVKKPIPESVFVQILEKLYEED IGAGMYALYPYGGIMDEISESAIPFPHRAGILYELWYICSWEKQE |

TABLE 1-continued

| Amino acid and nucleotide sequences of the disclosure | |
|---|---|
| | DNEKHLNWIRNIYNFMTPYVSKNPRLAYLNYRDLDIGINDPKNPN<br>NYTQARIWGEKYFGKNFDRLVKVKTLVDPNNFFRNEQSIPPLPRH<br>RH* |
| SEQ ID NO: 141<br>CBDA Synthase, V149I<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGattGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |
| SEQ ID NO: 142<br>CBDA Synthase, VI491<br>variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWIEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGVVNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>RHRH* |
| SEQ ID NO: 143<br>CBDA Synthase,<br>W161K variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCC<br>ATCCCACGTTTCTCACATCCAAGGTACCATCTTGTGTTCCAAAAA<br>GGTTGGTTTACAAATCCGTACTAGATCCGGTGGTCATGACTCCGA<br>AGGTATGTCTTACATTTCCCAAGTCCCTTTCGTCATCGTCGACTT<br>AAGAAATATGCGTTCCATCAAGATTGATGTCCATTCCCAAACTGC<br>TTGGGTTGAAGCCGGTGCCACTTTAGGTGAAGTCTATTACaaaGT<br>TAACGAGAAGAATGAGAACTTATCTTTGGCTGCCGGTTACTGTCC<br>AACTGTTTGTGCTGGTGGTCATTTCGGTGGTGGTGGTTACGGTCC<br>ATTAATGCGTAACTACGGTTTGGCTGCCGATAACATCATTGATGC<br>CCACTTAGTCAACGTTCATGGTAAGGTCTTGGACCGTAAGTCTAT<br>GGGTGAGGATTTATTCTGGGCTTTGAGAGGTGGTGGTGCTGAATC<br>TTTCGGTATTATCGTCGCTTGGAAGATTAGATTAGTTGCTGTTCC<br>AAAGTCTACTATGTTCTCTGTTAAGAAGATCATGGAAATTCACGA<br>GTTGGTTAAATTAGTTAACAAATGGCAAAACATTGCCTACAAGTA<br>CGATAAAGATTTGTTATTAATGACTCACTTTATCACTAGAAACAT<br>TACTGATAACCAAGGTAAGAATAAGACTGCCATTCACACTTACTT<br>CTCTTCTGTTTTCTTGGGTGGTGTTGATTCCTTGGTCGATTTGAT<br>GAACAAGTCTTTTCCAGAATTAGGTATTAAGAAGACCGATTGTCG |

TABLE 1-continued

| Amino acid and nucleotide sequences of the disclosure | |
|---|---|
| | TCAATTATCTTGGATTGATACCATTATTTTTTACTCCGGTGTTGT<br>CAACTACGACACTGATAATTTTAATAAGGAGATTTTGTTAGATAG<br>ATCTGCTGGTCAAAATGGTGCCTTTAAAATCAAATTGGACTACGT<br>TAAGAAGCCTATTCCAGAATCCGTCTTTGTTCAAATTTTGGAGAA<br>GTTATACGAAGAAGATATTGGTGCTGGTATGTACGCCTTGTATCC<br>ATATGGTGGTATTATGGATGAAATTTCTGAATCCGCCATCCCTTT<br>CCCTCATCGTGCTGGTATCTTATACGAGTTGTGGTACATCTGTTC<br>TTGGGAAAAGCAAGAAGATAATGAAAAGCATTTGAACTGGATCCG<br>TAACATCTATAACTTCATGACTCCATACGTTTCCAAAAACCCTAG<br>ATTGGCTTACTTAAATTACAGAGACTTAGATATTGGTATTAACGA<br>CCCTAAGAACCCAAACAATTACACTCAAGCTAGAATCTGGGGTGA<br>AAAGTACTTCGGTAAGAATTTCGACAGATTAGTTAAGGTCAAGAC<br>TTTAGTTGACCCAAATAACTTCTTCAGAAACGAACAATCTATCCC<br>ACCATTGCCTAGACATAGACACTAG |
| SEQ ID NO: 144<br>CBDA Synthase,<br>W161K variant<br>Artificial<br>Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYKVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKIKLDYVKKPIPESVFVQILEKLYEE<br>DIGAGMYALYPYGGIMDEISESAIPFPHRAGILYELWYICSWEKQ<br>EDNEKHLNWIRNTYNFMTPYVSKNPRLAYLNYRDLDIGINDPKNP<br>NNYTQARIWGEKYFGKNFDRLVKVKTLVDPNNFFRNEQSIPPLPR<br>HRH* |
| SEQ ID NO: 145<br>CBDA Synthase,<br>W161R variant<br>Artificial<br>Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACagaGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 146<br>CBDA Synthase,<br>W161R variant<br>Artificial<br>Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYRVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGVVNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN |

TABLE 1-continued

| Amino acid and nucleotide sequences of the disclosure | |
|---|---|
| | PNNYTQARIWGEKYFGKNFDRLVKVKTLVDPNNFFRNEQSIPPLP<br>RHRH* |
| SEQ ID NO: 147<br>CBDA Synthase,<br>W161Y variant<br>Artificial<br>Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTAClatGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 148<br>CBDA Synthase,<br>W161Y variant<br>Artificial<br>Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYYVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKKLDYVKKPIPESVFVQILEKLYEED<br>IGAGMYALYPYGGIMDEISESAIPFPHRAGILYELWYICSWEKQE<br>DNEKHLNWIRNIYNFMTPYVSKNPRLAYLNYRDLDIGINDPKNPN<br>NYTQARIVVGEKYFGKNFDRLVKVKTLVDPNNFFRNEQSIPPLPR<br>HRH* |
| SEQ ID NO: 149<br>CBDA Synthase,<br>K165A variant<br>Artificial<br>Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGgct<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT |

TABLE 1-continued

| Amino acid and nucleotide sequences of the disclosure | |
|---|---|
| | TGGATTGATACCATTATTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 150<br>CBDA Synthase,<br>K165A variant<br>Artificial<br>Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEANENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKKLDYVKKPIPESVFVQILEKLYEED<br>IGAGMYALYPYGGIMDEISESAIPFPHRAGILYELWYICSWEKQE<br>DNEKHLNWIRNIYNFMTPYVSKNPRLAYLNYRDLDIGINDPKNPN<br>NYTQARIWGEKYFGKNFDRLVKVKTLVDPNNFFRNEQSIPPLPRH<br>RH* |
| SEQ ID NO: 151<br>CBDA Synthase,<br>E167P variant<br>Artificial<br>Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATccaAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 152<br>CBDA Synthase,<br>E167P variant<br>Artificial<br>Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNPNLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKIKLDYVKKPIPESVFVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP |

TABLE 1-continued

| Amino acid and nucleotide sequences of the disclosure | |
|---|---|
| | NNYTQARIWGEKYFGKNFDRLVKVKTLVDPNNFFRNEQSIPPLPR<br>HRH* |
| SEQ ID NO: 153<br>CBDA Synthase,<br>N168S variant<br>Artificial<br>Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGtctTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 154<br>CBDA Synthase,<br>N168S variant<br>Artificial<br>Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNESLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKIKLDYVKKPIPESVFVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP<br>NNYTQARIWGEKYFGKNFDRLVKVKTLVDPNNFFRNEQSIPPLPR<br>HRH* |
| SEQ ID NO: 155<br>CBDA Synthase,<br>S170T variant<br>Artificial<br>Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTAactTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT |

TABLE 1-continued

| Amino acid and nucleotide sequences of the disclosure | |
|---|---|
| | TGGATTGATACCATTATTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 156<br>CBDA Synthase,<br>S170T variant<br>Artificial<br>Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLTLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGVVNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>RHRH* |
| SEQ ID NO: 157<br>CBDA Synthase, LI711<br>variant<br>Artificial<br>Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTattGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 158<br>CBDA Synthase, L171I<br>variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSIAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIME1HELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGVVNYD<br>TDNFNKEILLDRSAGQNGAFKIKLDYVKKP1PESVFVQ1LEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN |

TABLE 1-continued

| Amino acid and nucleotide sequences of the disclosure | |
|---|---|
| | PNNYTQARIWGEKYFGKNFDRLVKVKTLVDPNNFFRNEQSIPPLP<br>RHRH* |
| SEQ ID NO: 159<br>CBDA Synthase,<br>A172V variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGgttGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAAC<br>ATCTATAACTTCATGACTCCATACGTTTCCAAAAACCCTAGATTG<br>GCTTACTTAAATTACAGAGACTTAGATATTGGTATTAACGACCCT<br>AAGAACCCAAACAATTACACTCAAGCTAGAATCTGGGGTGAAAAG<br>TACTTCGGTAAGAATTTCGACAGATTAGTTAAGGTCAAGACTTTA<br>GTTGACCCAAATAACTTCTTCAGAAACGAACAATCTATCCCACCA<br>TTGCCTAGACATAGACACTAG |
| SEQ ID NO: 160<br>CBDA Synthase,<br>A172V variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYVVVNEKNENLSLVAGYCPTV<br>CAGGHFGGGGYGPLMRNYGLAADNIIDAHLVNVHGKVLDRKSMGE<br>DLFWALRGGGAESFGIIVAWKIRLVAVPKSTMFSVKKIMEIHELV<br>KLVNKWQNIAYKYDKDLLLMTHFITRNITDNQGKNKTAIHTYFSS<br>VFLGGVDSLVDLMNKSFPELGIKKTDCRQLSWIDTIIFYSGWNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>RHRH* |
| SEQ ID NO: 161<br>CBDA Synthase,<br>Y175F variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTtttTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT |

TABLE 1-continued

| Amino acid and nucleotide sequences of the disclosure | |
|---|---|
| | TGGATTGATACCATTATTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 162<br>CBDA Synthase,<br>Y175F variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYVVVNEKNENLSLAAGFCPTV<br>CAGGHFGGGGYGPLMRNYGLAADNIIDAHLVNVHGKVLDRKSMGE<br>DLFWALRGGGAESFGIIVAWKIRLVAVPKSTMFSVKKIMEIHELV<br>KLVNKWQNIAYKYDKDLLLMTHFITRNITDNQGKNKTAIHTYFSS<br>VFLGGVDSLVDLMNKSFPELGIKKTDCRQLSWIDTIIFYSGWNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>RHRH* |
| SEQ ID NO: 163<br>CBDA Synthase,<br>Cl80A variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTgct<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTn<br>TCTTGGGTGGTGTTGATrCCTTGGTCGATTTGATGAACAAGTCTT<br>TTCCAGAATTAGGTATTAAGAAGACCGATTGTCGTCAATTGATAA<br>TTTTAATAAGGAGATTTTGTTAGATAGATCTGCTGGTCAAAATGG<br>TGCCTTTAAAATCAAATTGGACTACGTTAAGAAGCCTATTCCAGA<br>ATCCGTCTTTGTTCAAATTTTGGAGAAGTTATACGAAGAAGATAT<br>TGGTGCTGGTATGTACGCCTTGTATCCATATGGTGGTATTATGGA<br>TGAAATTTCTGAATCCGCCATCCCTTTCCCTCATCGTGCTGGTAT<br>CTTATACGAGTTGTGGTACATCTGTTCTTGGGAAAAGCAAGAAGA<br>TAATGAAAAGCATTTGAACTGGATCCGTAACATCTATAACTTCAT<br>GACTCCATACGTTTCCAAAAACCCTAGATTGGCTTACTTAAATTA<br>CAGAGACTTAGATATTGGTATTAACGACCCTAAGAACCCAAACAA<br>TTACACTCAAGCTAGAATCTGGGGTGAAAAGTACTTCGGTAAGAA<br>TTTCGACAGATTAGTTAAGGTCAAGACTTTAGTTGACCCAAATAA<br>CTTCTTCAGAAACGAACAATCTATCCCACCATTGCCTAGACATAG<br>ACACTAG |
| SEQ ID NO: 164<br>CBDA Synthase,<br>Cl80A variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVA<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKIKLDYVKKPIPESVFVQILEKLYEE<br>DIGAGMYALYPYGGIMDEISESAIPFPHRAGILYELWYICSWEKQ |

TABLE 1-continued

| Amino acid and nucleotide sequences of the disclosure | |
|---|---|
| | EDNEKHLNWIRNIYNFMTPYVSKNPRLAYLNYRDLDIGINDPKNP NNYTQARIWGEKYFGKNFDRLVKVKTLVDPNNFFRNEQSIPPLPR HRH* |
| SEQ ID NO: 165 CBDA Synthase, A181V variant Artificial Sequence Codon optimized | ATGAAATGCTCCACTTTCTCTTTCTGGTTCGTTTGTAAGATTATC TTCTTCTTCTTTTCTTTCAACATCCAAACTTCCATTGCCAACCCT CGTGAGAACTTCTTGAAATGTTTTTCTCAATATATCCCAAATAAC GCTACTAACTTGAAGTTAGTCTATACTCAAAACAACCCATTATAT ATGTCTGTCTTAAACTCTACCATTCACAACTTACGTTTCACTTCT GATACTACTCCAAAACCTTTGGTCATCGTCACCCCATCCCACGTT TCTCACATCCAAGGTACCATCTTGTGTTCCAAAAAGGTTGGTTTA CAAATCCGTACTAGATCCGGTGGTCATGACTCCGAAGGTATGTCT TACATTTCCCAAGTCCCTTTCGTCATCGTCGACTTAAGAAATATG CGTTCCATCAAGATTGATGTCCATTCCCAAACTGCTTGGGTTGAA GCCGGTGCCACTTTAGGTGAAGTCTATTACTGGGTTAACGAGAAG AATGAGAACTTATCTTTGGCTGCCGGTTACTGTCCAACTGTTTGT gttGGTGGTCATTTCGGTGGTGGTGGTTACGGTCCATTAATGCGT AACTACGGTTTGGCTGCCGATAACATCATTGATGCCCACTTAGTC AACGTTCATGGTAAGGTCTTGGACCGTAAGTCTATGGGTGAGGAT TTATTCTGGGCTTTGAGAGGTGGTGGTGCTGAATCTTTCGGTATT ATCGTCGCTTGGAAGATTAGATTAGTTGCTGTTCCAAAGTCTACT ATGTTCTCTGTTAAGAAGATCATGGAAATTCACGAGTTGGTTAAA TTAGTTAACAAATGGCAAAACATTGCCTACAAGTACGATAAAGAT TTGTTATTAATGACTCACTTTATCACTAGAAACATTACTGATAAC CAAGGTAAGAATAAGACTGCCATTCACACTTACTTCTCTTCTGTT TTCTTGGGTGGTGTTGATTCCTTGGTCGATTTGATGAACAAGTCT TTTCCAGAATTAGGTATTAAGAAGACCGATTGTCGTCAATT GATAATTTTAATAAGGAGATTTTGTTAGATAGATCTGCTGGTCAA AATGGTGCCTTTAAAATCAAATTGGACTACGTTAAGAAGCCTATT CCAGAATCCGTCTTTGTTCAAATTTTGGAGAAGTTATACGAAGAA GATATTGGTGCTGGTATGTACGCCTTGTATCCATATGGTGGTATT ATGGATGAAATTTCTGAATCCGCCATCCCTTTCCCTCATCGTGCT GGTATCTTATACGAGTTGTGGTACATCTGTTCTTGGGAAAAGCAA GAAGATAATGAAAAGCATTTGAACTGGATCCGTAACATCTATAAC TTCATGACTCCATACGTTTCCAAAAACCCTAGATTGGCTTACTTA AATTACAGAGACTTAGATATTGGTATTAACGACCCTAAGAACCCA AACAATTACACTCAAGCTAGAATCTGGGGTGAAAAGTACTTCGGT AAGAATTTCGACAGATTAGTTAAGGTCAAGACTTTAGTTGACCCA AATAACTTCTTCAGAAACGAACAATCTATCCCACCATTGCCTAGA CATAGACACTAG |
| SEQ ID NO: 166 CBDA Synthase, A181V variant Artificial Sequence | MKCSTFSFWFVCKIIFFFFSFNIQTSIANPRENFLKCFSQYIPNN ATNLKLVYTQNNPLYMSVLNSTIHNLRFTSDTTPKPLVIVTPSHV SHIQGTILCSKKVGLQIRTRSGGHDSEGMSYISQVPFVIVDLRNM RSIKIDVHSQTAWVEAGATLGEVYYWVNEKNENLSLAAGYCPTVC VGGHFGGGGYGPLMRNYGLAADNIIDAHLVNVHGKVLDRKSMGED LFWALRGGGAESFGIIVAWKIRLVAVPKSTMFSVKKIMEIHELVK LVNKWQNIAYKYDKDLLLMTHFITRNITDNQGKNKTAIHTYFSSV FLGGVDSLVDLMNKSFPELGIKKTDCRQLSWIDTIIFYSGVVNYD TDNFNKEILLDRSAGQNGAFKIKLDYVKKPIPESVFVQILEKLYE EDIGAGMYALYPYGGIMDEISESAIPFPHRAGILYELWYICSWEK QEDNEKHLNVVIRNIYNFMTPYVSKNPRLAYLNYRDLDIGINDPK NPNNYTQARIWGEKYFGKNFDRLVKVKTLVDPNNFFRNEQSIPPL PRHRH* |
| SEQ ID NO: 167 CBDA Synthase, N196Q variant Artificial Sequence Codon optimized | ATGAAATGCTCCACTTTCTCTTTCTGGTTCGTTTGTAAGATTATC TTCTTCTTCTTTTCTTTCAACATCCAAACTTCCATTGCCAACCCT CGTGAGAACTTCTTGAAATGTTTTTCTCAATATATCCCAAATAAC GCTACTAACTTGAAGTTAGTCTATACTCAAAACAACCCATTATAT ATGTCTGTCTTAAACTCTACCATTCACAACTTACGTTTCACTTCT GATACTACTCCAAAACCTTTGGTCATCGTCACCCCATCCCACGTT TCTCACATCCAAGGTACCATCTTGTGTTCCAAAAAGGTTGGTTTA CAAATCCGTACTAGATCCGGTGGTCATGACTCCGAAGGTATGTCT TACATTTCCCAAGTCCCTTTCGTCATCGTCGACTTAAGAAATATG CGTTCCATCAAGATTGATGTCCATTCCCAAACTGCTTGGGTTGAA GCCGGTGCCACTTTAGGTGAAGTCTATTACTGGGTTAACGAGAAG AATGAGAACTTATCTTTGGCTGCCGGTTACTGTCCAACTGTTTGT GCTGGTGGTCATTTCGGTGGTGGTGGTTACGGTCCATTAATGCGT caaTACGGTTTGGCTGCCGATAACATCATTGATGCCCACTTAGTC AACGTTCATGGTAAGGTCTTGGACCGTAAGTCTATGGGTGAGGAT TTATTCTGGGCTTTGAGAGGTGGTGGTGCTGAATCTTTCGGTATT ATCGTCGCTTGGAAGATTAGATTAGTTGCTGTTCCAAAGTCTACT ATGTTCTCTGTTAAGAAGATCATGGAAATTCACGAGTTGGTTAAA TTAGTTAACAAATGGCAAAACATTGCCTACAAGTACGATAAAGAT TTGTTATTAATGACTCACTTTATCACTAGAAACATTACTGATAAC CAAGGTAAGAATAAGACTGCCATTCACACTTACTTCTCTTCTGTT TTCTTGGGTGGTGTTGATTCCTTGGTCGATTTGATGAACAAGTCT TTTCCAGAATTAGGTATTAAGAAGACCGATTGTCGTCAATTGATA |

TABLE 1-continued

| Amino acid and nucleotide sequences of the disclosure | |
|---|---|
| | ATTTTAATAAGGAGATTTTGTTAGATAGATCTGCTGGTCAAAATG GTGCCTTTAAAATCAAATTGGACTACGTTAAGAAGCCTATTCCAG AATCCGTCTTTGTTCAAATTTTGGAGAAGTTATACGAAGAAGATA TTGGTGCTGGTATGTACGCCTTGTATCCATATGGTGGTATTATGG ATGAAATTTCTGAATCCGCCATCCCTTTCCCTCATCGTGCTGGTA TCTTATACGAGTTGTGGTACATCTGTTCTTGGGAAAAGCAAGAAG ATAATGAAAAGCATTTGAACTGGATCCGTAACATCTATAACTTCA TGACTCCATACGTTTCCAAAAACCCTAGATTGGCTTACTTAAATT ACAGAGACTTAGATATTGGTATTAACGACCCTAAGAACCCAAACA ATTACACTCAAGCTAGAATCTGGGGTGAAAAGTACTTCGGTAAGA ATTTCGACAGATTAGTTAAGGTCAAGACTTTAGTTGACCCAAATA ACTTCTTCAGAAACGAACAATCTATCCCACCATTGCCTAGACATA GACACTAG |
| SEQ ID NO: 168 CBDA Synthase, N196Q variant Artificial Sequence | MKCSTFSFWFVCKIIFFFFSFNIQTSIANPRENFLKCFSQYIPNN ATNLKLVYTQNNPLYMSVLNSTIHNLRFTSDTTPKPLVIVTPSHV SHIQGTILCSKKVGLQIRTRSGGHDSEGMSYISQVPFVIVDLRNM RSIKIDVHSQTAWVEAGATLGEVYYWVNEKNENLSLAAGYCPTVC AGGHFGGGGYGPLMRQYGLAADNIIDAHLVNVHGKVLDRKSMGED LFWALRGGGAESFGIIVAWKIRLVAVPKSTMFSVKKIMEIHELVK LVNKWQNIAYKYDKDLLLMTHFITRNITDNQGKNKTAIHTYFSSV FLGGVDSLVDLMNKSFPELGIKKTDCRQLSWIDTIIFYSGVVNYD TDNFNKEILLDRSAGQNGAFKIKLDYVKKPIPESVFVQILEKLYE EDIGAGMYALYPYGGIMDEISESAIPFPHRAGILYELWYICSWEK QEDNEKHLNWIRNIYNFMTPYVSKNPRLAYLNYRDLDIGINDPKN PNNYTQARIWGEKYFGKNFDRLVKVKTLVDPNNFFRNEQSIPPLP RHRH* |
| SEQ ID NO: 169 CBDA Synthase, NI96T variant Artificial Sequence Codon optimized | ATGAAATGCTCCACTTTCTCTTTCTGGTTCGTTTGTAAGATTATC TTCTTCTTCTTTTCTTTCAACATCCAAACTTCCATTGCCAACCCT CGTGAGAACTTCTTGAAATGTTTTTCTCAATATATCCCAAATAAC GCTACTAACTTGAAGTTAGTCTATACTCAAAACAACCCATTATAT ATGTCTGTCTTAAACTCTACCATTCACAACTTACGTTTCACTTCT GATACTACTCCAAAACCTTTGGTCATCGTCACCCCATCCCACGTT TCTCACATCCAAGGTACCATCTTGTGTTCCAAAAAGGTTGGTTTA CAAATCCGTACTAGATCCGGTGGTCATGACTCCGAAGGTATGTCT TACATTTCCCAAGTCCCTTTCGTCATCGTCGACTTAAGAAATATG CGTTCCATCAAGATTGATGTCCATTCCCAAACTGCTTGGGTTGAA GCCGGTGCCACTTTAGGTGAAGTCTATTACTGGGTTAACGAGAAG AATGAGAACTTATCTTTGGCTGCCGGTTACTGTCCAACTGTTTGT GCTGGTGGTCATTTCGGTGGTGGTGGTTACGGTCCATTAATGCGT actTACGGTTTGGCTGCCGATAACATCATTGATGCCCACTTAGTC AACGTTCATGGTAAGGTCTTGGACCGTAAGTCTATGGGTGAGGAT TTATTCTGGGCTTTGAGAGGTGGTGGTGCTGAATCTTTCGGTATT ATCGTCGCTTGGAAGATTAGATTAGTTGCTGTTCCAAAGTCTACT ATGTTCTCTGTTAAGAAGATCATGGAAATTCACGAGTTGGTTAAA TTAGTTAACAAATGGCAAAACATTGCCTACAAGTACGATAAAGAT TTGTTATTAATGACTCACTTTATCACTAGAAACATTACTGATAAC CAAGGTAAGAATAAGACTGCCATTCACACTTACTTCTCTTCTGTT TTCTTGGGTGGTGTTGATTCCTTGGTCGATTTGATGAACAAGTCT TTTCCAGAATTAGGTATTAAGAAGACCGATTGTCGTCAATTGATA ATTTTAATAAGGAGATTTTGTTAGATAGATCTGCTGGTCAAAATG GTGCCTTTAAAATCAAATTGGACTACGTTAAGAAGCCTATTCCAG AATCCGTCTTTGTTCAAATTTTGGAGAAGTTATACGAAGAAGATA TTGGTGCTGGTATGTACGCCTTGTATCCATATGGTGGTATTATGG ATGAAATTTCTGAATCCGCCATCCCTTTCCCTCATCGTGCTGGTA TCTTATACGAGTTGTGGTACATCTGTTCTTGGGAAAAGCAAGAAG ATAATGAAAAGCATTTGAACTGGATCCGTAACATCTATAACTTCA TGACTCCATACGTTTCCAAAAACCCTAGATTGGCTTACTTAAATT ACAGAGACTTAGATATTGGTATTAACGACCCTAAGAACCCAAACA ATTACACTCAAGCTAGAATCTGGGGTGAAAAGTACTTCGGTAAGA ATTTCGACAGATTAGTTAAGGTCAAGACTTTAGTTGACCCAAATA ACTTCTTCAGAAACGAACAATCTATCCCACCATTGCCTAGACATA GACACTAG |
| SEQ ID NO: 170 CBDA Synthase, N196T variant Artificial Sequence | MKCSTFSFWFVCKIIFFFFSFNIQTSIANPRENFLKCFSQYIPNN ATNLKLVYTQNNPLYMSVLNSTIHNLRFTSDTTPKPLVIVTPSHV SHIQGTILCSKKVGLQIRTRSGGHDSEGMSYISQVPFVIVDLRNM RSIKIDVHSQTAWVEAGATLGEVYYWVNEKNENLSLAAGYCPTVC AGGHFGGGGYGPLMRTYGLAADNIIDAHLVNVHGKVLDRKSMGED LFWALRGGGAESFGIIVAWKIRLVAVPKSTMFSVKKIMEIHELVK LVNKWQNIAYKYDKDLLLMTHFITRNITDNQGKNKTAIHTYFSSV FLGGVDSLVDLMNKSFPELGIKKTDCRQLSWIDTIIFYSGVVNYD TDNFNKEILLDRSAGQNGAFKIKLDYVKKPIPESVFVQILEKLYE EDIGAGMYALYPYGGIMDEISESAIPFPHRAGILYELWYICSWEK QEDNEKHLNWIRNIYNFMTPYVSKNPRLAYLNYRDLDIGINDPKN PNNYTQARIWGEKYFGKNFDRLVKVKTLVDPNNFFRNEQSIPPLP RHRH* |

TABLE 1-continued

| Amino acid and nucleotide sequences of the disclosure | |
|---|---|
| SEQ ID NO: 171<br>CBDA Synthase,<br>N196V variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>gttTACGGTTTGGCTGCCGATAACATCATTGATGCCCACTTAGTC<br>AACGTTCATGGTAAGGTCTTGGACCGTAAGTCTATGGGTGAG<br>GATTTATTCTGGGCTTTGAGAGGTGGTGGTGCTGAATCTTTCGGT<br>ATTATCGTCGCTTGGAAGATTAGATTAGTTGCTGTTCCAAAGTCT<br>ACTATGTTCTCTGTTAAGAAGATCATGGAAATTCACGAGTTGGTT<br>AAATTAGTTAACAAATGGCAAAACATTGCCTACAAGTACGATAAA<br>GATTTGTTATTAATGACTCACTTTATCACTAGAAACATTACTGAT<br>AACCAAGGTAAGAATAAGACTGCCATTCACACTTACTTCTCTTCT<br>GTTTTCTTGGGTGGTGTTGATTCCTTGGTCGATTTGATGAACAAG<br>TCTTTTCCAGAATTAGGTATTAAGAAGACCGATTGTCGTCAATTG<br>ATAATTTTAATAAGGAGATTTTGTTAGATAGATCTGCTGGTCAAA<br>ATGGTGCCTTTAAAATCAAATTGGACTACGTTAAGAAGCCTATTC<br>CAGAATCCGTCTTTGTTCAAATTTTGGAGAAGTTATACGAAGAAG<br>ATATTGGTGCTGGTATGTACGCCTTGTATCCATATGGTGGTATTA<br>TGGATGAAATTTCTGAATCCGCCATCCCTTTCCCTCATCGTGCTG<br>GTATCTTATACGAGTTGTGGTACATCTGTTCTTGGGAAAAGCAAG<br>AAGATAATGAAAAGCATTTGAACTGGATCCGTAACATCTATAA<br>CTTCATGACTCCATACGTTTCCAAAAACCCTAGATT<br>GGCTTACTTAAATTACAGAGACTTAGATATTGGTATTAACGACC<br>CTAAGAACCCAAACAATTACACTCAAGCTAGAATCTGGGGTGAAA<br>AGTACTTCGGTAAGAATTTCGACAGATTAGTTAAGGTCAAGACTT<br>TAGTTGACCCAAATAACTTCTTCAGAAACGAACAATCTATCCCAC<br>CATTGCCTAGACATAGACACTAG |
| SEQ ID NO: 172<br>CBDA Synthase,<br>N196V variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYYVVNEKNENLSLAAGYCP<br>TVCAGGHFGGGGYGPLMRVYGLAADNIIDAHLVNVHGK<br>VLDRKSMGEDLFWALRGGGAESFGIIVAYVKIRLVAVPKSTMFSV<br>KKIMEIHELVKLVNKVVQNIAYKYDKDLLLMTHFITRNITDNQGK<br>NKTAIHTYFSSVFLGGVDSLVDLMNKSFPELGIKKTDCRQLSWID<br>TIIFYSGVVNYDTDNFNKEILLDRSAGQNGAFKIKLDYVKXPIPE<br>SVFVQILEKLYEEDIGAGMYALYPYGGIMDEISESAIPFPHRAGI<br>LYELWYICSWEKQEDNEKHLNVVIRNIYNFMTPYVSKNPRLAYLN<br>YRDLDIGINDPKNPNNYTQARIWGEKYFGKNFDRLVKVKTLVDPN<br>NFFRNEQSIPPLPRHRH* |
| SEQ ID NO: 173<br>CBDA Synthase,<br>H208T variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCA<br>AATAACGCTACTAACTTGAAGTTAGTCTATACTCAAAAC<br>AACCCATTATATATGTCTGTCTTAAACTCTACCATTCACAACTTA<br>CGTTTCACTTCTGATACTACTCCAAAACCTTTGGTCATCGTCACC<br>CCATCCCACGTTTCTCACATCCAAGGTACCATCTTGTGTTCCAAA<br>AAGGTTGGTTTACAAATCCGTACTAGATCCGGTGGTCATGACTCC<br>GAAGGTATGTCTTACATTTCCCAAGTCCCTTTCGTCATCGTC<br>GACTTAAGAAATATGCGTTCCATCAAGATTGATGTCCATT<br>CCCAAACTGCTTGGGTTGAAGCCGGTGCCACTTTAGGTGAAGTCT<br>ATTACTGGGTTAACGAGAAGAATGAGAACTTATCTTTGGCTGCCG<br>GTTACTGTCCAACTGTTTGTGCTGGTGGTCATTTCGGTGGTGGTG<br>GTTACGGTCCATTAATGCGTAACTACGGTTTGGCTGCCGATAACA<br>TCATTGATGCCactTTAGTCAACGTTCATGGTAAGGTCTT<br>GGACCGTAAGTCTATGGGTGAGGATTTATTCTGGGCTTTGAG<br>AGGTGGTGGTGCTGAATCTTTCGGTATTATCGTCGCTTGGAAGAT<br>TAGATTAGTTGCTGTTCCAAAGTCTACTATGTTCTCTGTTAAGAA<br>GATCATGGAAATTCACGAGTTGGTTAAATTAGTTAACAAATGGCA<br>AAACATTGCCTACAAGTACGATAAAGATTTGTTATTAATGACTCA<br>CTTTATCACTAGAAACATTACTGATAACCAAGGT<br>AAGAATAAGACTGCCATTCACACTTACTTCTCTTCTGT<br>TTTCTTGGGTGGTGTTGATTCCTTGGTCGATTTGATGAACAAGTC<br>TTTTCCAGAATTAGGTATTAAGAAGACCGATTGTCGTCAATTGAT<br>AATTTTAATAAGGAGATTTTGTTAGATAGATCTGCTGGTCAAAAT<br>GGTGCCTTTAAAATCAAATTGGACTACGTTAAGAAGCCTATTCCA |

TABLE 1-continued

| Amino acid and nucleotide sequences of the disclosure | |
|---|---|
| | GAATCCGTCTTTGTTCAAATTTTGGAGAAGTTATACGAAGAAGAT<br>ATTGGTGCTGGTATGTACGCCTTGTATCCATATGGTGGTATTATG<br>GATGAAATTTCTGAATCCGCCATCCCTTTCCCTCATCGTGCTGGT<br>ATCTTATACGAGTTGTGGTACATCTGTTCTTGGGAAAAGCAAGAA<br>GATAATGAAAAGCATTTGAACTGGATCCGTAACATCTATAACTTC<br>ATGACTCCATACGTTTCCAAAAACCCTAGATTGGCTTACTTAA<br>ATTACAGAGACTTAGATATTGGTATTAACGACCCT<br>AAGAACCCAAACAATTACACTCAAGCTAGAATCTGGGGT<br>GAAAAGTACTTCGGTAAGAATTTC<br>GACAGATTAGTTAAGGTCAAGACTTTAGTTGACCCAAATAACTTC<br>TTCAGAAACGAACAATCTATCCCACCATTGCCTAGA<br>CATAGACACTAG |
| SEQ ID NO: 174<br>CBDA Synthase,<br>H208T variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSH<br>VSHIQGTILCSKKVGLQIRTRSGGHDSEGMSYISQVPFVIVDLRN<br>MRSIKIDVHSQTAWVEAGATLGEVYYWVNEKNENLSLAAGYCPTV<br>CAGGHFGGGGYGPLMRNYGLAADNIIDATLVNVHGKVLDRKSMGE<br>DLFWALRGGGAESFGIIVAWKIRLVAVPKSTMFSVKKIMEIHELV<br>KLVNKWQNIAYKYDKDLLLMTHFITRNITDNQGKNKTAIHTYFSS<br>VFLGGVDSLVDLMNKSFPELGIKKTDCRQLSWIDTIIFYSGWNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>RHRH* |
| SEQ ID NO: 175<br>CBDA Synthase,<br>A235P variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCC<br>ATTATATATGTCTGTCTTAAACTCTACCATTCACAA<br>CTTACGTTTCACTTCTGATACTACTCCAAAACCTTT<br>GGTCATCGTCACCCCATCCCACGTTTCTCACATCCAAGGTACC<br>ATCTTGTGTTCCAAAAAGGTTGGTTTACAAATCCGTACTA<br>GATCCGGTGGTCATGACTCCGAAGGTATGTCTTACATTTC<br>CCAAGTCCCTTTCGTCATCGTCGACTTAAGAAATATGCGTTCCAT<br>CAAGATTGATGTCCATTCCCAAACTGCTTGGGTTGAAGCCGGTGC<br>CACTTTAGGTGAAGTCTATTACTGGGTTAACGAGAAGAATGAGAA<br>CTTATCTTTGGCTGCCGGTTACTGTCCAACTGTTTGTGCTGGTGG<br>TCATTTCGGTGGTGGTGGTTACGGTCCATTAATGCGTAACTACGG<br>TTTGGCTGCCGATAACATCATTGATGCCCACTTAGTCAACGTTCA<br>TGGTAAGGTCTTGGACCGTAAGTCTATGGGTGAGGATTTATTCTG<br>GGCTTTGAGAGGTGGTGGTccaGAATCTTTCGGTATTATCGTCGC<br>TTGGAAGATTAGATTAGTTGCTGTTCCAAAGTCTACTATGTTCTC<br>TGTTAAGAAGATCATGGAAATTCACGAGTTGGTTAAATTAGTTAA<br>CAAATGGCAAAACATTGCCTACAAGTACGATA<br>AAGATTTGTTATTAATGACTCACTTTATCACTAGA<br>AACATTACTGATAACCAAGGTAAGAATAAGACTGCCATTCA<br>CACTTACTTCTCTTCTGTTTTCTTGGGTGGTGTTGATTCCTTGGT<br>CGATTTGATGAACAAGTCTTTTCCAGAATTAGGTATT<br>AAGAAGACCGATTGTCGTCAACTGATAATTTTAATAAGG<br>AGATTTTGTTAGATAGATCTGCTGGTCAAAATGGTGCCTTTAA<br>AATCAAATTGGACTACGTTAAGAAGCCTATTCCAG<br>AATCCGTCTTTGTTCAAATTTTGGAGAAGTTATACGAAGAAGAT<br>ATTGGTGCTGGTATGTACGCCTTGTATCCATATGGTGGTATTATG<br>GATGAAATTTCTGAATCCGCCATCCCTTTCCCTCATCGTGCTGG<br>TATCTTATACGAGTTGTGGTACATCTGTTCTTGGGAAAAGCAAGA<br>AGATAATGAAAAGCATTTGAACTGGATCCGTAACATCTATAACTT<br>CATGACTCCATACGTTTCCAAAAACCCTAGATTGGCTTACTTAAA<br>TTACAGAGACTTAGATATTGGTATTAACGACCCTAAGAACCCAAA<br>CAATTACACTCAAGCTAGAATCTGGGGTGAAAAGTACTTCGGTAA<br>GAATTTCGACAGATTAGTTAAGGTCAAGACTTTAGTTGACCCAAA<br>TAACTTCTTCAGAAACGAACAATCTATCCCACCATTGCCTAGACA<br>TAGACACTAG |
| SEQ ID NO: 176<br>CBDA Synthase,<br>A235P variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSH<br>VSHIQGTILCSKKVGLQIRTRSGGHDSEGMSYISQVPFVIVDLRN<br>MRSIKIDVHSQTAWVEAGATLGEVYYWVNEKNENLSLAAGYCPTV<br>CAGGHFGGGGYGPLMRNYGLAADNIIDAHLVNVHGKVLDRKSMGE<br>DLFWALRGGGPESFGIIVAWKIRLVAVPKSTMFSVKKIMEIHELV<br>KLVNKWQNIAYKYDKDLLLMTHFITRNITDNQGKNKTAIHTYFSS<br>VFLGGVDSLVDLMNKSFPELGIKKTDCRQLSWIDTIIFYSGVVNY<br>DTDNFNKEILLDRSAGQNGAFKIKLDYVKKPIPESVFVQILEKLY<br>EEDIGAGMYALYPYGGIMDEISESAIPFPHRAGILYELWYICSWE |

TABLE 1-continued

| Amino acid and nucleotide sequences of the disclosure | |
|---|---|
| | KQEDNEKHLNVVIRNIYNFMTPYVSKNPRLAYLNYRDLDIGINDP<br>KNPNNYTQARIWGEKYFGKNFDRLVKVKTLVDPNNFFRNEQSIPP<br>LPRHRH* |
| SEQ ID NO: 177<br>CBDA Synthase,<br>A250T variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCA<br>AATAACGCTACTAACTTGAAGTTAGTCTATACTCAAAA<br>CAACCCATTATATATGTCTGTCTTAAACTCTACCATTCACAACTT<br>ACGTTTCACTTCTGATACTACTCCAAAACCTTTGGTCATC<br>GTCACCCCATCCCACGTTTCTCACATCCAAGGTACCATCTTGTGT<br>TCCAAAAAGGTTGGTTTACAAATCCGTACTAGATCCGGTGGTCA<br>TGACTCCGAAGGTATGTCTTACATTTCCCAAGTCCCTTTCGTCA<br>TCGTCGACTTAAGAAATATGCGTTCCATCAAGATTGATGTCCATT<br>CCCAAACTGCTTGGGTTGAAGCCGGTGCCACTTTAGGTGAAGTCT<br>ATTACTGGGTTAACGAGAAGAATGAGAACTTATCTTTGGCTGCCG<br>GTTACTGTCCAACTGTTTGTGCTGGTGGTCATTTCGGTGGTGGTG<br>GTTACGGTCCATTAATGCGTAACTACGGTTTGGCTGCCGATAACA<br>TCATTGATGCCCACTTAGTCAACGTTCATGGTAAGGTCTTGGACC<br>GTAAGTCTATGGGTGAGGATTTATTCTGGGCTTTGAGAGGTG<br>GTGGTGCTGAATCTTTCGGTATTATCGTCGCTTGGAAGATT<br>AGATTAGTTactGTTCCAAAGTCTACTATGTTCTCTGTTAAGAAG<br>ATCATGGAAATTCACGAGTTGGTTAAATTAGTTAACAAATGGCAA<br>AACATTGCCTACAAGTACGATAAAGATTTGTTATTAATGACTCAC<br>TTTATCACTAGAAACATTACTGATAACCAAGGTAAGAATAAGACT<br>GCCATTCACACTTACTTCTCTTCTGTTTTCTTGGGTGGTGTTGAT<br>TCCTTGGTCGATTTGATGAACAAGTCTTTTCCAGAATTAGGTATT<br>AAGAAGACCGATTGTCGTCAACTGATAATTTTAATAAGGAGATTT<br>TGTTAGATAGATCTGCTGGTCAAAATGGTGCCTTTAAAATCAAAT<br>TGGACTACGTTAAGAAGCCTATTCCAGAATCCGTCTTTGTTC<br>AAATTTTGGAGAAGTTATACGAAGAAGATATTGGTGCT<br>GGTATGTACGCCTTGTATCCATATGGTGGTATTATGGATGAAATT<br>TCTGAATCCGCCATCCCTTTCCCTCATCGTGCTGGTATCTTATA<br>CGAGTTGTGGTACATCTGTTCTTGGGAAAAGCAAGAAGATAATGA<br>AAAGCATTTGAACTGGATCCGTAACATCTATAACTTCATGAC<br>TCCATACGTTTCCAAAAACCCTAGATTGGCTTACTTAAA<br>TTACAGAGACTTAGATATTGGTATTAACGACCCTAAGAACCCAAA<br>CAATTACACTCAAGCTAGAATCTGGGGTGAAAAGTACTTCGGTAA<br>GAATTTCGACAGATTAGTTAAGGTCAAGACTTTAGTTGACCCAAA<br>TAACTTCTTCAGAAACGAACAATCTATCCCACCATT<br>GCCTAGACATAGACACTAG |
| SEQ ID NO: 178<br>CBDA Synthase,<br>A250T variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSH<br>VSHIQGTILCSKKVGLQIRTRSGGHDSEGMSYISQVPFVIVDLRN<br>MRSIKIDVHSQTAWVEAGATLGEVYYWVNEKNENLSLAAGYCPTV<br>CAGGHFGGGGYGPLMRNYGLAADNIIDAHLVNVHGKVLDRKSMGE<br>DLFWALRGGGAESFGIIVAWKIRLVTVPKSTMFSVKKIMEIHELV<br>KLVNKWQNIAYKYDKDLLLMTHFITRNITDNQGKNKTAIHTYFSS<br>VFLGGVDSLVDLMNKSFPELGIKKTDCRQLSWIDTIIFYSGWNYD<br>TDNFNKEILLDRSAGQNGAFKKLDYVKKPIPESVFVQILEK<br>LYEEDIGAGMYALYPYGGIMDEISESAIPFPHRAGILYELWY<br>ICSWEKQEDNEKHLNWIRNIYNFMTPYVSKNPRLAYLNYRDLDIG<br>INDPKNPNNYTQARIVVGEKYFGKNFDRLVKVKTLVDPNNFFRN<br>EQSIPPLPRHRH* |
| SEQ ID NO: 179<br>CBDA Synthase,<br>M256V variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTC<br>TGATACTACTCCAAAACCTTTGGTCATCGTCACCCCATCC<br>CACGTTTCTCACATCCAAGGTACCATCTTGTGTTCCAAAAAGGTT<br>GGTTTACAAATCCGTACTAGATCCGGTGGTCATGACTCCGAAGG<br>TATGTCTTACATTTCCCAAGTCCCTTTCGTCATCGTCGACTTA<br>AGAAATATGCGTTCCATCAAGATTGATGTCCATTCCCAAACTGCT<br>TGGGTTGAAGCCGGTGCCACTTTAGGTGAAGTCTATTACTGGGTT<br>AACGAGAAGAATGAGAACTTATCTTTGGCTGCCGGTTACTGTCCA<br>ACTGTTTGTGCTGGTGGTCATTTCGGTGGTGGTGGTTACGGTCCA<br>TTAATGCGTAACTACGGTTTGGCTGCCGATAACATCATTGATGCC<br>CACTTAGTCAACGTTCATGGTAAGGTCTTGGACCGTAAGTCTATG<br>GGTGAGGATTTATTCTGGGCTTTGAGAGGTGGTGGTGCTGAATCT<br>TTCGGTATTATCGTCGCTTGGAAGATTAGATTAGTTGCTGTTCCA<br>AAGTCTACTgUTTCTCTGTTAAGAAGATCATGGAAATTCACGAGT<br>TGGTTAAATTAGTTAACAAATGGCAAAACATTGCCTAC<br>AAGTACGATAAAGATTTGTTATTAATGACTCACT<br>TTATCACTAGAAACATTACTGATAACCAAGGTAAGAATAAGACTG<br>CCATTCACACTTACTTCTCTTCTGTTTTCTTGGGTGGTGTTGATT |

TABLE 1-continued

| Amino acid and nucleotide sequences of the disclosure | |
|---|---|
| | CCTTGGTCGATTTGATGAACAAGTCTTTTCCAGAATTAGGTATTA<br>AGAAGACCGATTGTCGTCAACTGATAATTTTAATAAGGAGATTTT<br>GTTAGATAGATCTGCTGGTCAAAATGGTGCCTTTAAAATCAAATT<br>GGACTACGTTAAGAAGCCTATTCCAGAATCCG<br>TCTTTGTTCAAATTTTGGAGAAGTTATACGAAGAAGATATTGGTG<br>CTGGTATGTACGCCTTGTATCCATATGGTGGTATTATGG<br>ATGAAATTTCTGAATCCGCCATCCCTTTCCCTCATCGTGC<br>TGGTATCTTATACGAGTTGTGGTACATCTGTTCTTGGGAAAAGCA<br>AGAAGATAATGAAAAGCATTTGAACTGGATCCGTAACATCTATAA<br>CTTCATGACTCCATACGTTTCCAAAAACCCTAGATTGGCTTACTT<br>AAATTACAGAGACTTAGATATTGGTATTAACGA<br>CCCTAAGAACCCAAACAATTACACTCAAGCTAGAATCTGGG<br>GTGAAAAGTACTTCGGTAAGAATTTCGACAGATTAGTTAAGGTCA<br>AGACTTTAGTTGACCCAAATAACTTCTTCAGAAACGAACAATCTA<br>TCCCACCATTGCCTAGACATAGACACTAG |
| SEQ ID NO: 180<br>CBDA Synthase,<br>M256V variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSH<br>VSHIQGTILCSKKVGLQIRTRSGGHDSEGMSYISQVPFVIVDLRN<br>MRSIKIDVHSQTAWVEAGATLGEVYYWVNEKNENLSLAAGYCPTV<br>CAGGHFGGGGYGPLMRNYGLAADNIIDAHLVNVHGKVLDRKSMGE<br>DLFWALRGGGAESFGIIVAWKIRLVAVPKSTVFSVKKIMEIHELV<br>KLVNKWQNIAYKYDKDLLLMTHFITRNITDNQGKNKTAIHTYFSS<br>VFLGGVDSLVDLMNKSFPELGIKKTDCRQLSWIDTIIFYSGWNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>RHRH* |
| SEQ ID NO: 181<br>CBDA Synthase,<br>K260C variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAG<br>TCAACGTTCATGGTAAGGTCTTGGACCGTAAGTCTATG<br>GGTGAGGATTTATTCTGGGCTTTGAGAGGTGGTGGTGCTGAATCT<br>TTCGGTATTATCGTCGCTTGGAAGATTAGATTAGTTGCTGTTCCA<br>AAGTCTACTATGTTCTCTGTTtgtAAGATCATGGAAATTCACGAG<br>TTGGTTAAATTAGTTAACAAATGGCAAAACATTGCCTACAAGTAC<br>GATAAAGATTTGTTATTAATGACTCACTTTATCACTAGAAACATT<br>ACTGATAACCAAGGTAAGAATAAGACTGCCATTCACACTTACTTC<br>TCTTCTGTTTTCTTGGGTGGTGTTGATTCCTTGGTCGATTTGATG<br>AACAAGTCTTTTCCAGAATTAGGTATTAAGAAGACCGATTGTCGT<br>CAATTGATAATTTTAATAAGGAGATTTTGTTAGATAGATCTGCTG<br>GTCAAAATGGTGCCTTTAAAATCAAATTGGACTACGTTAAGAAGC<br>CTATTCCAGAATCCGTCTTTGTTCAAATTTTGGAGAAGTTATAC<br>GAAGAAGATATTGGTGCTGGTATGTACGCCTTGTATCCATAT<br>GGTGGTATTATGGATGAAATTTCTGAATCCGCCATCCCTTTCCCT<br>CATCGTGCTGGTATCTTATACGAGTTGTGGTACATCTGTTCTTGG<br>GAAAAGCAAGAAGATAATGAAAAGCATTTGAACTGGATCCGTAAC<br>ATCTATAACTTCATGACTCCATACGTTTCCAAAAACCCTAGATTG<br>GCTTACTTAAATTACAGAGACTTAGATATTGGTATTAACGACCCT<br>AAGAACCCAAACAATTACACTCAAGCTAGAATCTGGGGTGAAAAG<br>TACTTCGGTAAGAATTTCGACAGATTAGTTAAGGTCA<br>AGACTTTAGTTGACCCAAATAACTTCTTCAGAAACG<br>AACAATCTATCCCACCATTGCCTAGACATAGACA<br>CTAG |
| SEQ ID NO: 182<br>CBDA Synthase,<br>K260C variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSH<br>VSHIQGTILCSKKVGLQIRTRSGGHDSEGMSYISQVPFVIVDLRN<br>MRSIKIDVHSQTAWVEAGATLGEVYYWVNEKNENLSLAAGYCPTV<br>CAGGHFGGGGYGPLMRNYGLAADNIIDAHLVNVHGKVLDRKSMG<br>EDLFWALRGGGAESFGIIVAWKIRLVAVPKSTMFSVCKIMEIHEL<br>VKLVNKWQNIAYKYDKDLLLMTHFITRNITDNQGKNKTAIHTYFS<br>SVFLGGVDSLVDLMNKSFPELGIKKTDCRQLSWIDTIIFYSG<br>VVNYDTDNFNKEILLDRSAGQNGAFKKLDYVKKPIPESVFV<br>QILEKLYEEDIGAGMYALYPYGGIMDEISESAIPFPHRAGIL |

TABLE 1-continued

| Amino acid and nucleotide sequences of the disclosure | |
|---|---|
| | YELWYICSWEKQEDNEKHLNWIRNIYNFMTPYVSKNPRLAYLNYR<br>DLDIGINDPKNPNNYTQARIWGEKYFGKNFDRLVKVKTLVDPNNF<br>FRNEQSIPPLPRHRH* |
| SEQ ID NO: 183<br>CBDA Synthase,<br>K260W variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAG<br>TCTACTATGTTCTCTGTTtggAAGATCATGGAAATTCACGAGT<br>TGGTTAAATTAGTTAACAAATGGCAAAACATTGCCTACAAGTACG<br>ATAAAGATTTGTTATTAATGACTCACTTTATCACTAGAAACA<br>TTACTGATAACCAAGGTAAGAATAAGACTGCCA<br>TTCACACTTACTTCTCTTCTGTTTTCTTGGGTGGTGTTGATTCC<br>TTGGTCGATTTGATGAACAAGTCTTTTCCAGAATTAG<br>GTATTAAGAAGACCGATTGTCGTCAATTGATAATTT<br>TAATAAGGAGATTTTGTTAGATAGATCTGCTGGTCAAAATGGTGC<br>CTTTAAAATCAAATTGGACTACGTTAAGAAGCCTATTCCAGAA<br>TCCGTCTTTGTTCAAATTTTGGAGAAGTTATACGAAGAAGATATT<br>GGTGCTGGTATGTACGCCTTGTATCCATATGGTGGTATTATG<br>GATGAAATTTCTGAATCCGCCATCCCTTTCCCTCATCGTGCTGGT<br>ATCTTATACGAGTTGTGGTACATCTGTTCTTGGGAAAAGCAAGAA<br>GATAATGAAAAGCATTTGAACTGGATCCGTAACATCTATAA<br>CTTCATGACTCCATACGTTTCCAAAAACCCTAG<br>ATTGGCTTACTTAAATTACAGAGACTTAGATATTGGTATTAACG<br>ACCCTAAGAACCCAAACAATTACACTCAAGCTAGAATCTGGGGTG<br>AAAAGTACTTCGGTAAGAATTTCGACAGATTAGTTAAGGTCAAGA<br>CTTTAGTTGACCCAAATAACTTCTTCAGAAACGAACAATCT<br>ATCCCACCATTGCCTAGACATAGACACTAG |
| SEQ ID NO: 184<br>CBDA Synthase,<br>K260W variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSH<br>VSHIQGTILCSKKVGLQIRTRSGGHDSEGMSYISQVPFVIVDLRN<br>MRSIKIDVHSQTAWVEAGATLGEVYYWVNEKNENLSLAAGYCPTV<br>CAGGHFGGGGYGPLMRNYGLAADNIIDAHLVNVHGKVLDRKSMGE<br>DLFWALRGGGAESFGIIVAWKIRLVAVPKSTMFSVWKIMEIHEL<br>VKLVNKWQNIAYKYDKDLLLMTHFITRNITDNQGKNKTAIHTY<br>FSSVFLGGVDSLVDLMNKSFPELGIKKTDCRQLSWIDTIIFYSG<br>WNYDTDNFNKEILLDRSAGQNGAFKIKLDYVKKPIPESVFVQILE<br>KLYEEDIGAGMYALYPYGGIMDEISESAIPFPHRAGILYELWYIC<br>SWEKQEDNEKHLNWIRNIYNFMTPYVSKNPRLAYLNYRDLDIGIN<br>DPKNPNNYTQARIWGEKYFGKNFDRLVKVKTLVDPNNFFRNEQSI<br>PPLPRHRH* |
| SEQ ID NO: 185<br>CBDA Synthase, L268I<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTT<br>ACAAATCCGTACTAGATCCGGTGGTCATGACTCCGAAG<br>GTATGTCTTACATTTCCCAAGTCCCTTTCGTCATCGTCGACTT<br>AAGAAATATGCGTTCCATCAAGATTGATGTCCATTCCCAAACTGC<br>TTGGGTTGAAGCCGGTGCCACTTTAGGTGAAGTCTATTACTGGGT<br>TAACGAGAAGAATGAGAACTTATCTTTGGCTGCCGGTTACTGTCC<br>AACTGTTTGTGCTGGTGGTCATTTCGGTGGTGGTGGTTACGGTCC<br>ATTAATGCGTAACTACGGTTTGGCTGCCGATAACATCATTGATGC<br>CCACTTAGTCAACGTTCATGGTAAGGTCTTGGACCGTAAGTCT<br>ATGGGTGAGGATTTATTCTGGGCTTTGAGAGGTGGTGGTGCTGAA<br>TCTTTCGGTATTATCGTCGCTTGGAAGATTAGATTAGTTGCTGTT<br>CCAAAGTCTACTATGTTCTCTGTTAAGAAGATCATGGAAATTCAC<br>GAGattGTTAAATTAGTTAACAAATGGCAAAACATTGCCTACAAG<br>TACGATAAAGATTTGTTATTAATGACTCACTTTATCACTAGA<br>AACATTACTGATAACCAAGGTAAGAATAAGAC<br>TGCCATTCACACTTACTTCTCTTCTGTTTTCTTGGGTGGTGTT |

TABLE 1-continued

| Amino acid and nucleotide sequences of the disclosure | |
|---|---|
| | GATTCCTTGGTCGATTTGATGAACAAGTCTTTTCCAGAATTAGGT ATTAAGAAGACCGATTGTCGTCAATTGATAATTTTAATAAGGAGA TTTTGTTAGATAGATCTGCTGGTCAAAATGGTGCCTTTAAAATCA AATTGGACTACGTTAAGAAGCCTATTCCAGAATCCGTCTTTGTTC AAATTTTGGAGAAGTTATACGAAGAAGATATTG GTGCTGGTATGTACGCCTTGTATCCATATGGTGGTATT ATGGATGAAATTTCTGAATCCGCCATCCCTTTCCCTCATC GTGCTGGTATCTTATACGAGTTGTGGTACATCTGTTCTTGGGAAA AGCAAGAAGATAATGAAAAGCATTTGAACTGGATCCGTAAC ATCTATAACTTCATGACTCCATACGTTTCCAAAA ACCCTAGATTGGCTTACTTAAATTACAGAGACTTAGAT ATTGGTATTAACGACCCTAAGAACCCAAACAATTACACTC AAGCTAGAATCTGGGGTGAAAAGTACTTCGGTAAGAATTTCGACA GATTAGTTAAGGTCAAGACTTTAGTTGACCCAAAT AACTTCTTCAGAAACGAACAATCTATCCCACCATTGCCTAGACA TAGACACTAG |
| SEQ ID NO: 186<br>CBDA Synthase,<br>L268I<br>variant<br>Artificial Sequence | MKCSTFSFWFVCKIIFFFFSFNIQTSIANPRENFLKCFSQYIPNN ATNLKLVYTQNNPLYMSVLNSTIHNLRFTSDTTPKPLVIVTPSH VSHIQGTILCSKKVGLQIRTRSGGHDSEGMSYISQVPFVIVDLR NMRSIKIDVHSQTAWVEAGATLGEVYYWVNEKNENLSLAAGYCPT VCAGGHFGGGGYGPLMRNYGLAADNIIDAHLVNVHGKVLDRKSMG EDLFWALRGGGAESFGIIVAWKIRLVAVPKSTMFSVKKIMEIHEI VKLVNKWQNIAYKYDKDLLLMTHFITRNITDNQGKNKTAIHTYFS SVFLGGVDSLVDLMNKSFPELGIKKTDCRQLSWIDTIIFYSGWNY DTDNFNKEILLDRSAGQNGAFKIKLDYVKKPIPESVFVQILEK LYEEDIGAGMYALYPYGGIMDEISESAIPFPHRAGILYELWY ICSWEKQEDNEKHLNWIRNIYNFMTPYVSKNPRLAYLNYRDLDIG INDPKNPNNYTQARIWGEKYFGKNFDRLVKVKTLVDPNNFFRNEQ SIPPLPRHRH* |
| SEQ ID NO: 187<br>CBDA Synthase,<br>H309V variant<br>Artificial Sequence<br>Codon optimized | ATGAAATGCTCCACTTTCTCTTTCTGGTTCGTTTGTAAGATTATC TTCTTCTTCTTTTCTTTCAACATCCAAACTTCCATTGCCAACCCT CGTGAGAACTTCTTGAAATGTTTTTCTCAATATATCCCAAATAAC GCTACTAACTTGAAGTTAGTCTATACTCAAAACAACCCATTATAT ATGTCTGTCTTAAACTCTACCATTCACAACTTACGTTTCACTTC TGATACTACTCCAAAACCTTTGGTCATCGTCACCCCATCCC ACGTTTCTCACATCCAAGGTACCATCTTGTGTTCCAAAAAGGTTG GTTTACAAATCCGTACTAGATCCGGTGGTCATGACTCCGAAGGT ATGTCTTACATTTCCCAAGTCCCTTTCGTCATCGTCGACTTAA GAAATATGCGTTCCATCAAGATTGATGTCCATTCCCAAACTGCTT GGGTTGAAGCCGGTGCCACTTTAGGTGAAGTCTATTACTGGGTTA ACGAGAAGAATGAGAACTTATCTTTGGCTGCCGGTTACTGTCCAA CTGTTTGTGCTGGTGGTCATTTCGGTGGTGGTGGTTACGGTCCAT TAATGCGTAACTACGGTTTGGCTGCCGATAACATCATTGATGCCC ACTTAGTCAACGTTCATGGTAAGGTCTTGGACCGTAAGTCTATGG GTGAGGATTTATTCTGGGCTTTGAGAGGTGGTGGTGCTGAATCTT TCGGTATTATCGTCGCTTGGAAGATTAGATTAGTTGCTGTTC CAAAGTCTACTATGTTCTCTGTTAAGAAGATCATG GAAATTCACGAGTTGGTTAAATTAGTTAACAA ATGGCAAAACATTGCCTACAAGTACGATAAAGATTTGTTATTAAT GACTCACTTTATCACTAGAAACATTACTGATAACCAAGGT AAGAATAAGACTGCCATTgttACTTACTTCTCTTCTGTTTTCTT GGGTGGTGTTGATTCCTTGGTCGATTTGATGAACAAGTCTTTTC CAGAATTAGGTATTAAGAAGACCGATTGTCGTCAATTGATAA TTTTAATAAGGAGATTTTGTTAGATAGATCTGCTGGTCAAAATGG TGCCTTTAAAATCAAATTGGACTACGTTAAGAAGCCTATTCCAGA ATCCGTCTTTGTTCAAATTTTGGAGAAGTTATACGAAGAAGATAT TGGTGCTGGTATGTACGCCTTGTATCCATATGGTGGTATT ATGGATGAAATTTCTGAATCCGCCATCCCTTTCCCTCA TCGTGCTGGTATCTTATACGAGTTGTGGTACATCTGTTCTTGGG AAAAGCAAGAAGATAATGAAAAGCATTTGAACT GGATCCGTAACATCTATAACTTCATGACTCCATACGTTTCCAAA AACCCTAGATTGGCTTACTTAAATTACAGAGACTTAGATATTGGT ATTAACGACCCTAAGAACCCAAACAATTACACTCAAGCTAGAATC TGGGGTGAAAAGTACTTCGGTAAGAATTTCGACAGATTAGTTAAG GTCAAGACTTTAGTTGACCCAAATAACTTCTTCAGAAACGAACAA TCTATCCCACCATTGCCTAGACATAGACACTAG |
| SEQ ID NO: 188<br>CBDA Synthase,<br>H309V variant<br>Artificial Sequence | MKCSTFSFWFVCKIIFFFFSFNIQTSIANPRENFLKCFSQYIPNN ATNLKLVYTQNNPLYMSVLNSTIHNLRFTSDTTPKPLVIVTPSH VSHIQGTILCSKKVGLQIRTRSGGHDSEGMSYISQVPFVIV DLRNMRSIKIDVHSQTAWVEAGATLGEVYYWVNEKNENLSLAA GYCPTVCAGGHFGGGGYGPLMRNYGLAADNIIDAHL VNVHGKVLDRKSMGEDLFWALRGGGAESFGIIVAWKIRLVAVPKS TMFSVKKIMEIHELVKLVNKWQNIAYKYDKDLLLMTHFITRNITD NQGKNKTAIVTYFSSVFLGGVDSLVDLMNKSFPELGIKKTDCRQL SWIDTIIFYSGVVNYDTDNFNKEILLDRSAGQNGAFKIKLDYVKK |

TABLE 1-continued

| Amino acid and nucleotide sequences of the disclosure | |
|---|---|
| | PIPESVFVQILEKLYEEDIGAGMYALYPYGGIMDEISESAIPFPH<br>RAGILYELWYICSWEKQEDNEKHLNWIRNIYNFMTPYVSKNPRLA<br>YLNYRDLDIGINDPKNPNNYTQARIWGEKYFGKNFDRLVKVKTLV<br>DPNNFFRNEQSIPPLPRHRH* |
| SEQ ID NO: 189<br>CBDA Synthase,<br>T310A variant<br>Artificial Sequence<br>Codon optimi/ed | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCC<br>ATTATATATGTCTGTCTTAAACTCTACCATTCACAA<br>CTTACGTTTCACTTCTGATACTACTCCAAAACCTTTGGTCATCGT<br>CACCCCATCCCACGTTTCTCACATCCAAGGTACCATCTTGTGTTC<br>CAAAAAGGTTGGTTTACAAATCCGTACTAGATCCGGTGGTCATGA<br>CTCCGAAGGTATGTCTTACATTTCCCAAGTCCCTTTCGTCATCGT<br>CGACTTAAGAAATATGCGTTCCATCAAGATTGATGTCCATTCCCA<br>AACTGCTTGGGTTGAAGCCGGTGCCACTTTAGGTGAAGTCTATTA<br>CTGGGTTAACGAGAAGAATGAGAACTTATCTTTGGCTGCCGGTTA<br>CTGTCCAACTGTTTGTGCTGGTGGTCATTTCGGTGGTGGTGGTTA<br>CGGTCCATTAATGCGTAACTACGGTTTGGCTGCCGATAACATCAT<br>TGATGCCCACTTAGTCAACGTTCATGGTAAGGTCTTGGACCGTAA<br>GTCTATGGGTGAGGATTTATTCTGGGCTTTGAGAGGTGGTGGTGC<br>TGAATCTTTCGGTATTATCGTCGCTTGGAAGATTAGATTAGTT<br>GCTGTTCCAAAGTCTACTATGTTCTCTGTTAAGAAGATC<br>ATGGAAATTCACGAGTTGGTTAAATTAGTTAACA<br>AATGGCAAAACATTGCCTACAAGTACGATAAAGATTTGTTATTA<br>ATGACTCACTTTATCACTAGAAACATTACTGATAACCA<br>AGGTAAGAATAAGACTGCCATTCACgctTACTTCTCTTCTG<br>TTTTCTTGGGTGGTGTTGATTCCTTGGTCGATTTGATGAAC<br>AAGTCTTTTCCAGAATTAGGTATTAAGAAGACCGATTGTCGTCAA<br>TTGATAATTTTAATAAGGAGATTTTGTTAGATAGATCTGCTGGTC<br>AAAATGGTGCCTTTAAAATCAAATTGGACTACGTTAAGAAGCCTA<br>TTCCAGAATCCGTCTTTGTTCAAATTTTGGAGAAGTTATACGA<br>AGAAGATATTGGTGCTGGTATGTACGCCTTGTATCCATATGGTG<br>GTATTATGGATGAAATTTCTGAATCCGCCATCCCTTTCCCTC<br>ATCGTGCTGGTATCTTATACGAGTTGTGGTACATCTGTTCTTGGG<br>AAAAGCAAGAAGATAATGAAAAGCATTTGAACTGGATCCGTA<br>ACATCTATAACTTCATGACTCCATACGTTTCCAA<br>AAACCCTAGATTGGCTTACTTAAATTACAGAGACTT<br>AGATATTGGTATTAACGACCCTAAGAACCCAAAC<br>AATTACACTCAAGCTAGAATCTGGGGTGAAAAGTACTTCGGTAAG<br>AATTTCGACAGATTAGTTAAGGTCAAGACTTTAGTTGA<br>CCCAAATAACTTCTTCAGAAACGAACAATCTATCCC<br>ACCATTGCCTAGACATAGACACTAG |
| SEQ ID NO: 190<br>CBDA Synthase,<br>T310A variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPT<br>VCAGGHFGGGGYGPLMRNYGLAADNIIDAHLVNVHGKVLDRKSM<br>GEDLFWALRGGGAESFGIIVAWKIRLVAVPKSTMFSVKKIMEIHE<br>LVKLVNKVVQNIAYKYDKDLLLMTHFITRNITDNQGKNKTAIHAY<br>FSSVFLGGVDSLVDLMNKSFPELGIKKTDCRQLSWIDTIIFYSGW<br>NYDTDNFNKEILLDRSAGQNGAFKIKLDYVKKPIPESVFVQILEK<br>LYEEDIGAGMYALYPYGGIMDEISESAIPFPHRAGILYELWYICS<br>WEKQEDNEKHLNWIRNIYNFMTPYVSKNPRLAYLNYRDLDIGIND<br>PKNPNNYTQARIWGEKYFGKNFDRLVKVKTLVDPNNFFRNEQSIP<br>PLPRHRH* |
| SEQ ID NO: 191<br>CBDA Synthase,<br>T310C variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTT<br>CTGATACTACTCCAAAACCTTTGGTCATCGTCACCCCA<br>TCCCACGTTTCTCACATCCAAGGTACCATCTTGTGTTCCAAAAAG<br>GTTGGTTTACAAATCCGTACTAGATCCGGTGGTCATGA<br>CTCCGAAGGTATGTCTTACATTTCCCAAGTCCCTTTCGTCAT<br>CGTCGACTTAAGAAATATGCGTTCCATCAAGATTGATGTCCATTC<br>CCAAACTGCTTGGGTTGAAGCCGGTGCCACTTTAGGTGAAGTCTA<br>TTACTGGGTTAACGAGAAGAATGAGAACTTATCTTTGGCTGCCGG<br>TTACTGTCCAACTGTTTGTGCTGGTGGTCATTTCGGTGGTGGTGG<br>TTACGGTCCATTAATGCGTAACTACGGTTTGGCTGCCGATAACAT<br>CATTGATGCCCACTTAGTCAACGTTCATGGTAAGGTCTTGGACCG<br>TAAGTCTATGGGTGAGGATTTATTCTGGGCTTTGAGAGGTGGTGG<br>TGCTGAATCTTTCGGTATTATCGTCGCTTGGAAGATTAGAT<br>TAGTTGCTGTTCCAAAGTCTACTATGTTCTCTGTTAAGAA<br>GATCATGGAAATTCACGAGTTGGTTAAATTAGTTAACAAATGGCA<br>AAACATTGCCTACAAGTACGATAAAGATTTGTTATTAATGACTCA |

TABLE 1-continued

| Amino acid and nucleotide sequences of the disclosure | |
|---|---|
| | CTTTATCACTAGAAACATTACTGATAACCAAGGTAAGAATAAGAC<br>TGCCATTCACtgtTACTTCTCTTCTGTTTTCTTGGGTGGTGTTGA<br>TTCCTTGGTCGATTTGATGAACAAGTCTTTTCCAGAATTAGGTAT<br>TAAGAAGACCGATTGTCGTCAATTATCTTGGATTGATACCATTAT<br>TTTTTACTCCGGTGTTGTCAACTACGACACTGATAATTTTAATAA<br>GGAGATTTTGTTAGATAGATCTGCTGGTCAAAATGGTGCCTTTAA<br>AATCAAATTGGACTACGTTAAGAAGCCTATTCCAGAATCCGTCTT<br>TGTTCAAATTTTGGAGAAGTTATACGAAGAAGATA<br>TTGGTGCTGGTATGTACGCCTTGTATCCATATGGTGGTAT<br>TATGGATGAAATTTCTGAATCCGCCATCCCTTTCCCTC<br>ATCGTGCTGGTATCTTATACGAGTTGTGGTACATCTGTTCTTGGG<br>AAAAGCAAGAAGATAATGAAAAGCATTTGAACTGGATCCGTA<br>ACATCTATAACTTCATGACTCCATACGTTTCCAAAAACCCTAGAT<br>TGGCTTACTTAAATTACAGAGACTTAGATATTGGTATTAACGACC<br>CTAAGAACCCAAACAATTACACTCAAGCTAGAATCTGGGGTGAAA<br>AGTACTTCGGTAAGAATTTCGACAGATTAGTTAAGGTCAAGACTT<br>TAGTTGACCCAAATAACTTCTTCAGAAACGAACAATCT<br>ATCCCACCATTGCCTAGACATAGACACTAG |
| SEQ ID NO: 192<br>CBDA Synthase,<br>T310C variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSH<br>VSHIQGTILCSKKVGLQIRTRSGGHDSEGMSYISQVPFVIVDLRN<br>MRSIKIDVHSQTAWVEAGATLGEVYYWVNEKNENLSLAAGYCP<br>TVCAGGHFGGGGYGPLMRNYGLAADNIIDAHLVNVHGKVLDRKS<br>MGEDLFWALRGGGAESFGIIVAWKIRLVAVPKSTMFSVKKIMEIH<br>ELVKLVNKVVQNIAYKYDKDLLLMTHFITRNITDNQGKNKTAIHC<br>YFSSVFLGGVDSLVDLMNKSFPELGIKKTDCRQLSWIDTIIFYSG<br>WNYDTDNFNKEILLDRSAGQNGAFKIKLDYVKKPIPESVFVQI<br>LEKLYEEDIGAGMYALYPYGGIMDEISESAIPFPHRAGILYELWY<br>ICSWEKQEDNEKHLNWIRNIYNFMTPYVSKNPRLAYLNYRDLDIG<br>INDPKNPNNYTQARIWGEKYFGKNFDRLVKVKTLVDPNNFFRNEQ<br>SIPPLPRHRH* |
| SEQ ID NO: 193<br>CBDA Synthase,<br>F316Y variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCC<br>ATTATATATGTCTGTCTTAAACTCTACCATTCACAA<br>CTTACGTTTCACTTCTGATACTACTCCAAAACCTTTGGTCATCGT<br>CACCCCATCCCACGTTTCTCACATCCAAGGTACCATCTTGTGTTC<br>CAAAAAGGTTGGTTTACAAATCCGTACTAGATCCGGTGGTCATGA<br>CTCCGAAGGTATGTCTTACATTTCCCAAGTCCCTTTCGTCATCGT<br>CGACTTAAGAAATATGCGTTCCATCAAGATTGATGTCCATTCCCA<br>AACTGCTTGGGTTGAAGCCGGTGCCACTTTAGGTGAAGTCTATTA<br>CTGGGTTAACGAGAAGAATGAGAACTTATCTTTGGCTGCCGGTTA<br>CTGTCCAACTGTTTGTGCTGGTGGTCATTTCGGTGGTGGTGGTTA<br>CGGTCCATTAATGCGTAACTACGGTTTGGCTGCCGATAACATCAT<br>TGATGCCCACTTAGTCAACGTTCATGGTAAGGTCTTGGACCGTAA<br>GTCTATGGGTGAGGATTTATTCTGGGCTTTGAGAGGTGGTGGTGC<br>TGAATCTTTCGGTATTATCGTCGCTTGGAAGATTAGATTAGTTGC<br>TGTTCCAAAGTCTACTATGTTCTCTGTTAAGAAGATCATGGAAAT<br>TCACGAGTTGGTTAAATTAGTTAACAAATGGCAAAACATTGCCTA<br>CAAGTACGATAAAGATTTGTTATTAATGACTCACTTTATCACT<br>AGAAACATTACTGATAACCAAGGTAAGAATAAGACTG<br>CCATTCACACTTACTTCTCTTCTGTTtatTTGGGTGGTGTTGATT<br>CCTTGGTCGATTTGATGAACAAGTCTTTTCCAGAATT<br>AGGTATTAAGAAGACCGATTGTCGTCAATTGATAAT<br>TTTAATAAGGAGATTTTGTTAGATAGATCTGCTGGTCAAAATGGT<br>GCCTTTAAAATCAAATTGGACTACGTTAAGAAGCCTATTCCAGA<br>ATCCGTCTTTGTTCAAATTTTGGAGAAGTTATACGAAGAAGAT<br>ATTGGTGCTGGTATGTACGCCTTGTATCCATATGGTGGTA<br>TTATGGATGAAATTTCTGAATCCGCCATCCCTTTCCCTCA<br>TCGTGCTGGTATCTTATACGAGTTGTGGTACATCTGTTCTTGGGA<br>AAAGCAAGAAGATAATGAAAAGCATTTGAACTGGATCCGTAA<br>GGTGAAGTCTATTACTGGGTTAACGAGAAGAATGAGAACTTATCT<br>TTGGCTGCCGGTTACTGTCCAACTGTTTGTGCTGGTGGTCATTTC<br>GGTGGTGGTGGTTACGGTCCATTAATGCGTAACTACGGTTTGGCT<br>GCCGATAACATCATTGATGCCCACTTAGTCAACGTTCATGGTAAG<br>GTCTTGGACCGTAAGTCTATGGGTGAGGATTTATTCTGGGCTTTG<br>AGAGGTGGTGGTGCTGAATCTTTCGGTATTATCGTCGCTTGGA<br>AGATTAGATTAGTTGCTGTTCCAAAGTCTACTATGTTC<br>TCTGTTAAGAAGATCATGGAAATTCACGAGTTGGTTAAATTAGTT<br>AACAAATGGCAAAACATTGCCTACAAGTACGATAAAGATTTGTTA<br>TTAATGACTCACTTTATCACTAGAAACATTACTGATAACCAAGGT<br>AAGAATAAGACTGCCATTCACtgtTACTTCTCTTCTGTTTTCTTG<br>GGTGGTGTTGATTCCTTGGTCGATTTGATGAACAAGTCTTTTCCA<br>GAATTAGGTATTAAGAAGACCGATTGTCGTCAATTATCTTGGATT<br>GATACCATTATTTTTTACTCCGGTGTTGTCAACTACGACACTGAT |

TABLE 1-continued

| Amino acid and nucleotide sequences of the disclosure | |
|---|---|
| | AATTTTAATAAGGAGATTTTGTTAGATAGATCTGCTGGTCAAAAT<br>GGTGCCTTTAAAATCAAATTGGACTACGTTAAGAAGCCTATTCCA<br>GAATCCGTCTTTGTTCAAATTTTGGAGAAGTTATACGA<br>AGAAGATATTGGTGCTGGTATGTACGCCTTGTATCCAT<br>ATGGTGGTATTATGGATGAAATTTCTGAATCCGCCAT<br>CCCTTTCCCTCATCGTGCTGGTATCTTATACGAGTTGTGGTACAT<br>CTGTTCTTGGGAAAAGCAAGAAGATAATGAAAAGCATTTGAAC<br>TGGATCCGTAACATCTATAACTTCATGACTCCATACGTTTCCAA<br>AAACCCTAGATTGGCTTACTTAAATTACAGAGACTTAGATATTGG<br>TATTAACGACCCTAAGAACCCAAACAATTACACTCAAGCTAGAAT<br>CTGGGGTGAAAAGTACTTCGGTAAGAATTTCGACAGATTAGTTAA<br>GGTCAAGACTTTAGTTGACCCAAATAACTTCTTCAGAAACGA<br>ACAATCTATCCCACCATTGCCTAGACATAGACAC<br>TAG |
| SEQ ID NO: 192<br>CBDA Synthase,<br>T310C variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSH<br>VSHIQGTILCSKKVGLQIRTRSGGHDSEGMSYISQVPFVIVDLRN<br>MRSIKIDVHSQTAWVEAGATLGEVYYWVNEKNENLSLAAGYCP<br>TVCAGGHFGGGGYGPLMRNYGLAADNIIDAHLVNVHGKVLDRKS<br>MGEDLFWALRGGGAESFGIIVAWKIRLVAVPKSTMFSVKKIMEIH<br>ELVKLVNKVVQNIAYKYDKDLLLMTHFITRNITDNQGKNKTAIHC<br>YFSSVFLGGVDSLVDLMNKSFPELGIKKTDCRQLSWIDTIIFYSG<br>WNYDTDNFNKEILLDRSAGQNGAFKIKLDYVKKPIPESVFVQI<br>LEKLYEEDIGAGMYALYPYGGIMDEISESAIPFPHRAGILYELWY<br>ICSWEKQEDNEKHLNWIRNIYNFMTPYVSKNPRLAYLNYRDLDIG<br>INDPKNPNNYTQARIWGEKYFGKNFDRLVKVKTLVDPNNFFRNEQ<br>SIPPLPRHRH* |
| SEQ ID NO: 193<br>CBDA Synthase,<br>F316Y variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCC<br>ATTATATATGTCTGTCTTAAACTCTACCATTCACAA<br>CTTACGTTTCACTTCTGATACTACTCCAAAACCTTTGGTCATCGT<br>CACCCCATCCCACGTTTCTCACATCCAAGGTACCATCTTGTGTTC<br>CAAAAAGGTTGGTTTACAAATCCGTACTAGATCCGGTGGTCATGA<br>CTCCGAAGGTATGTCTTACATTTCCCAAGTCCCTTTCGTCATCGT<br>CGACTTAAGAAATATGCGTTCCATCAAGATTGATGTCCATTCCCA<br>AACTGCTTGGGTTGAAGCCGGTGCCACTTTAGGTGAAGTCTATTA<br>CTGGGTTAACGAGAAGAATGAGAACTTATCTTTGGCTGCCGGTTA<br>CTGTCCAACTGTTTGTGCTGGTGGTCATTTCGGTGGTGGTGGTTA<br>CGGTCCATTAATGCGTAACTACGGTTTGGCTGCCGATAACATCAT<br>TGATGCCCACTTAGTCAACGTTCATGGTAAGGTCTTGGACCGTAA<br>GTCTATGGGTGAGGATTTATTCTGGGCTTTGAGAGGTGGTGGTGC<br>TGAATCTTTCGGTATTATCGTCGCTTGGAAGATTAGATTAGTTGC<br>TGTTCCAAAGTCTACTATGTTCTCTGTTAAGAAGATCATGGAAAT<br>TCACGAGTTGGTTAAATTAGTTAACAAATGGCAAAACATTGCCTA<br>CAAGTACGATAAAGATTTGTTATTAATGACTCACTTTATCACT<br>AGAAACATTACTGATAACCAAGGTAAGAATAAGACTG<br>CCATTCACACTTACTTCTCTTCTGTTtatTTGGGTGGTGTTGATT<br>CCTTGGTCGATTTGATGAACAAGTCTTTTCCAGAATT<br>AGGTATTAAGAAGACCGATTGTCGTCAATTGATAAT<br>TTTAATAAGGAGATTTTGTTAGATAGATCTGCTGGTCAAAATGGT<br>GCCTTTAAAATCAAATTGGACTACGTTAAGAAGCCTATTCCAGA<br>ATCCGTCTTTGTTCAAATTTTGGAGAAGTTATACGAAGAAGAT<br>ATTGGTGCTGGTATGTACGCCTTGTATCCATATGGTGGTA<br>TTATGGATGAAATTTCTGAATCCGCCATCCCTTTCCCTCA<br>TCGTGCTGGTATCTTATACGAGTTGTGGTACATCTGTTCTTGGGA<br>AAAGCAAGAAGATAATGAAAAGCATTTGAACTGGATCCGTAA<br>CATCTATAACTTCATGACTCCATACGTTTCCAAAAACCCTAGATT<br>GGCTTACTTAAATTACAGAGACTTAGATATTGGTATTAACGACCC<br>TAAGAACCCAAACAATTACACTCAAGCTAGAATCTGGGGTGAAAA<br>GTACTTCGGTAAGAATTTCGACAGATTAGTTAAGGTCAAGACTTT<br>AGTTGACCCAAATAACTTCTTCAGAAACGAACAATCTATCCCACC<br>ATTGCCTAGACATAGACACTAG |
| SEQ ID NO: 194<br>CBDA Synthase,<br>F316Y variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>YLGGVDSLVDLMNKSFPELGIKKTDCRQLSWIDTIIFYSGWNYDT<br>DNFNKEILLDRSAGQNGAFKIKLDYVKKPIPESVFVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP |

TABLE 1-continued

| Amino acid and nucleotide sequences of the disclosure | |
|---|---|
| | NNYTQARIWGEKYFGKNFDRLVKVKTLVDPNNFFRNEQSIPPLPR<br>HRH* |
| SEQ ID NO: 195<br>CBDA Synthase, L326I<br>variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATattATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 196<br>CBDA Synthase, L326I<br>variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAVVVEAGATLGEVYYVVVNEKNENLSLAAGYCPT<br>VCAGGHFGGGGYGPLMRNYGLAADNIIDAHLVNVHGKVLDRKSMG<br>EDLFWALRGGGAESFGIIVAWKIRLVAVPKSTMFSVKKIMEIHEL<br>VKLVNKWQNIAYKYDKDLLLMTHFITRNITDNQGKNKTAIHTYFS<br>SVFLGGVDSLVDIMNKSFPELGIKKTDCRQLSWIDTIIFYSGVVN<br>YDTDNFNKEILLDRSAGQNGAFKIKLDYVKKPIPESVFVQILEKL<br>YEEDIGAGMYALYPYGGIMDEISESAIPFPHRAGILYELWYICSV<br>VEKQEDNEKHLNWIRNIYNFMTPYVSKNPRLAYLNYRDLDIGIND<br>PKNPNNYTQARIWGEKYFGKNFDRLVKVKTLVDPNNFFRNEQSIP<br>PLPRHRH* |
| SEQ ID NO: 197<br>CBDA Synthase,<br>G378T variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTG<br>AAATGTTTTTCTCAATATATCCCAAATAACGCTACTAACTTGAAG<br>TTAGTCTATACTCAAAACAACCCATTATATATGTCTGTCTTAAAC<br>TCTACCATTCACAACTTACGTTTCACTTCTGATACTACTCCAAAA<br>CCTTTGGTCATCGTCACCCCATCCCACGTTTCTCACATCCAAGGT<br>ACCATCTTGTGTTCCAAAAAGGTTGGTTTACAAATCCGTACTAGA<br>TCCGGTGGTCATGACTCCGAAGGTATGTCTTACATTTCCCAAGTC<br>CCTTTCGTCATCGTCGACTTAAGAAATATGCGTTCCATCAAGATT<br>GATGTCCATTCCCAAACTGCTTGGGTTGAAGCCGGTGCCACTTTA<br>GGTGAAGTCTATTACTGGGTTAACGAGAAGAATGAGAACTTATCT<br>TTGGCTGCCGGTTACTGTCCAACTGTTTGTGCTGGTGGTCATTTC<br>GGTGGTGGTGGTTACGGTCCATTAATGCGTAACTACGGTTTGGCT<br>GCCGATAACATCATTGATGCCCACTTAGTCAACGTTCATGGTAAG<br>GTCTTGGACCGTAAGTCTATGGGTGAGGATTTATTCTGGGCTTTG<br>AGAGGTGGTGGTGCTGAATCTTTCGGTATTATCGTCGCTTGGAAG<br>ATTAGATTAGTTGCTGTTCCAAAGTCTACTATGTTCTCTGTTAA<br>GAAGATCATGGAAATTCACGAGTTGGTTAAATTAGTTAACAAATG<br>GCAAAACATTGCCTACAAGTACGATAAAGATTTGTTATTAATGAC<br>TCACTTTATCACTAGAAACATTACTGATAACCAAGGTAAGAATAA<br>GACTGCCATTCACACTTACTTCTCTTCTGTTTTCTTGGGTGGTGT<br>TGATTCCTTGGTCGATTTGATGAACAAGTCTTTTCCAGA |

TABLE 1-continued

| Amino acid and nucleotide sequences of the disclosure | |
|---|---|
| | ATTAGGTATTAAGAAGACCGATTGTCGTCAACTGAT AATTTTAATAAGGAGATTTTGTTAGATAGATCTGCTGG TCAAAATactGCCTTTAAAATCAAATTGGACTACGTTAAGA AGCCTATTCCAGAATCCGTCTTTGTTCAAATTTTGGAGAAGTTAT ACGAAGAAGATATTGGTGCTGGTATGTACGCCTTGTATCCAT ATGGTGGTATTATGGATGAAATTTCTGAATCCGCCATC CCTTTCCCTCATCGTGCTGGTATCTTATACGAGTTGTGGTACATC TGTTCTTGGGAAAAGCAAGAAGATAATGAAAAGCATTTGAACTGG ATCCGTAACATCTATAACTTCATGACTCCATACGTTTCCAAAAAC CCTAGATTGGCTTACTTAAATTACAGAGACTTAGATATTGGTATT AACGACCCTAAGAACCCAAACAATTACACTCAAGCTAGAATCTGG GGTGAAAAGTACTTCGGTAAGAATTTCGACAGATTAGTTAAGGTC AAGACTTTAGTTGACCCAAATAACTTCTTCAGAAACGAACAATCT ATCCCACCATTGCCTAGACATAGACACTAG |
| SEQ ID NO: 198<br>CBDA Synthase,<br>G378T variant<br>Artificial Sequence | MKCSTFSFWFVCKIIFFFFSFNIQTSIANPRENFLKCFSQYIPNN ATNLKLVYTQNNPLYMSVLNSTIHNLRFTSDTTPKPLVIVTPSH VSHIQGTILCSKKVGLQIRTRSGGHDSEGMSYISQVPFVIVDLRN MRSIKIDVHSQTAWVEAGATLGEVYYWVNEKNENLSLAAGYCPTV CAGGHFGGGGYGPLMRNYGLAADNIIDAHLVNVHGKVLDRKSMGE DLFWALRGGGAESFGIIVAWKIRLVAVPKSTMFSVKKIMEIHELV KLVNKWQNIAYKYDKDLLLMTHFITRNITDNQGKNKTAIHTYFSS VFLGGVDSLVDLMNKSFPELGIKKTDCRQLSWIDTIIFYSGWNYD TDNFNKEILLDRSAGQNTAFKIKLDYVKKPIPESVFVQILEKLYE EDIGAGMYALYPYGGIMDEISESAIPFPHRAGILYELWYICSWEK QEDNEKHLNWIRNIYNFMTPYVSKNPRLAYLNYRDLDIGINDPKN PNNYTQARIWGEKYFGKNFDRLVKVKTLVDPNNFFRNEQSIPPLP RHRH* |
| SEQ ID NO: 199<br>CBDA Synthase,<br>G378S variant<br>Artificial Sequence<br>Codon optimized | ATGAAATGCTCCACTTTCTCTTTCTGGTTCGTTTGTAAGATTATC TTCTTCTTCTTTTCTTTCAACATCCAAACTTCCATTGCCAACCCT CGTGAGAACTTCTTGAAATGTTTTTCTCAATATATCCCAAATAAC GCTACTAACTTGAAGTTAGTCTATACTCAAAACAACCCATTATAT ATGTCTGTCTTAAACTCTACCATTCACAACTTACGTTTCACTTCT GATACTACTCCAAAACCTTTGGTCATCGTCACCCCATCCCACGTT TCTCACATCCAAGGTACCATCTTGTGTTCCAAAAAGGTTGGTTT ACAAATCCGTACTAGATCCGGTGGTCATGACTCCGA AGGTATGTCTTACATTTCCCAAGTCCCTTTCGTCATCGTCGAC TTAAGAAATATGCGTTCCATCAAGATTGATGTCCATTCCCAAACT GCTTGGGTTGAAGCCGGTGCCACTTTAGGTGAAGTCTATTACTGG GTTAACGAGAAGAATGAGAACTTATCTTTGGCTGCCGGTTACTGT CCAACTGTTTGTGCTGGTGGTCATTTCGGTGGTGGTGGTTACGGT CCATTAATGCGTAACTACGGTTTGGCTGCCGATAACATCATTGAT GCCCACTTAGTCAACGTTCATGGTAAGGTCTTGGACCGTAAGTCT ATGGGTGAGGATTTATTCTGGGCTTTGAGAGGTGGTGGTGCTGAA TCTTTCGGTATTATCGTCGCTTGGAAGATTAGATTAGTTGCTG TTCCAAAGTCTACTATGTTCTCTGTTAAGAAGATC ATGGAAATTCACGAGTTGGTTAAATTAGTTAACA AATGGCAAAACATTGCCTACAAGTACGATAAAGATTTGTTATT AATGACTCACTTTATCACTAGAAACATTACTGATAACCA AGGTAAGAATAAGACTGCCATTCACACTTACTTCTCTTCT GTTTTCTTGGGTGGTGTTGATTCCTTGGTCGATTTGATGAACAAG TCTTTTCCAGAATTAGGTATTAAGAAGACCGATTGTCGTCAA CTGATAATTTTAATAAGGAGATTTTGTTAGATAG ATCTGCTGGTCAAAATtctGCCTTTAAAATCAAATTGGAC TACGTTAAGAAGCCTATTCCAGAATCCGTCTTTGTTCAAATT TTGGAGAAGTTATACGAAGAAGATATTGGTGCTGGT ATGTACGCCTTGTATCCATATGGTGGTATTATGGATGAAATTTC TGAATCCGCCATCCCTTTCCCTCATCGTGCTGGTATCTTATACGA GTTGTGGTACATCTGTTCTTGGGAAAAGCAAGAAGATAATGAAAA GCATTTGAACTGGATCCGTAACATCTATAACTTCATGACTCCATA CGTTTCCAAAAACCCTAGATTGGCTTACTTAAATTACAGAGACTT AGATATTGGTATTAACGACCCTAAGAACCCAAACAATTACACTCA AGCTAGAATCTGGGGTGAAAAGTACTTCGGTAAGAATTTCGACAG ATTAGTTAAGGTCAAGACTTTAGTTGACCCAAATAACTTCTTCAG AAACGAACAATCTATCCCACCATTGCCTAGACATAGACACTAG |
| SEQ ID NO: 200<br>CBDA Synthase,<br>G378S variant<br>Artificial Sequence | MKCSTFSFWFVCKIIFFFFSFNIQTSIANPRENFLKCFSQYIPNN ATNLKLVYTQNNPLYMSVLNSTIHNLRFTSDTTPKPLVIVTPSH VSHIQGTILCSKKVGLQIRTRSGGHDSEGMSYISQVPFVIVDLRN MRSIKIDVHSQTAWVEAGATLGEVYYWVNEKNENLSLAAGYCPT VCAGGHFGGGGYGPLMRNYGLAADNIIDAHLVNVHGKVLDRKSM GEDLFWALRGGGAESFGIIVAWKIRLVAVPKSTMFSVKKIMEIHE LVKLVNKWQNIAYKYDKDLLLMTHFITRNITDNQGKNKTAIHTYF SSVFLGGVDSLVDLMNKSFPELGIKKTDCRQLSWIDTIIFYSGVV NYDTDNFNKEILLDRSAGQNSAFKIKLDYVKKPIPESVFVQIL EKLYEEDIGAGMYALYPYGGIMDEISESAIPFPHRAGILYELWYI CSWEKQEDNEKHLNVVIRNIYNFMTPYVSKNPRLAYLNYRDLDIG |

TABLE 1-continued

| Amino acid and nucleotide sequences of the disclosure | |
|---|---|
| | INDPKNPNNYTQARIWGEKYFGKNFDRLVKVKTLVDPNNFFRNEQ<br>SIPPLPRHRH* |
| SEQ ID NO: 201<br>CBDA Synthase,<br>K389E variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCC<br>AAATAACGCTACTAACTTGAAGTTAGTCTATACTC<br>AAAACAACCCATTATATATGTCTGTCTTAAACTCTACCATTCACA<br>ACTTACGTTTCACTTCTGATACTACTCCAAAACCTTTGGTCATCG<br>TCACCCCATCCCACGTTTCTCACATCCAAGGTACCATCTTGTGTT<br>CCAAAAAGGTTGGTTTACAAATCCGTACTAGATCCGGTGGTCATG<br>ACTCCGAAGGTATGTCTTACATTTCCCAAGTCCCTTTCGTCATCG<br>TCGACTTAAGAAATATGCGTTCCATCAAGATTGATGTCCATTCCC<br>AAACTGCTTGGGTTGAAGCCGGTGCCACTTTAGGTGAAGTCTA<br>TTACTGGGTTAACGAGAAGAATGAGAACTTATCTTTGGC<br>TGCCGGTTACTGTCCAACTGTTTGTGCTGGTGGTCATTTCGGTGG<br>TGGTGGTTACGGTCCATTAATGCGTAACTACGGTTTGGCTGCCGA<br>TAACATCATTGATGCCCACTTAGTCAACGTTCATGGTAAGGTCTT<br>GGACCGTAAGTCTATGGGTGAGGATTTATTCTGGGCTTTGAGAGG<br>TGGTGGTGCTGAATCTTTCGGTATTATCGTCGCTTGGAAGATTAG<br>ATTAGTTGCTGTTCCAAAGTCTACTATGTTCTCTGTTAAGAAGA<br>TCATGGAAATTCACGAGTTGGTTAAATTAGTTAACAAATGGCAAA<br>ACATTGCCTACAAGTACGATAAAGATTTGTTATTAATGACTCACT<br>TTATCACTAGAAACATTACTGATAACCAAGGTAAGAATAAGACTG<br>CCATTCACACTTACTTCTCTTCTGTTTTCTTGGGTGGTGTTGATT<br>CCTTGGTCGATTTGATGAACAAGTCTTTTCCAGAATTAG<br>GTATTAAGAAGACCGATTGTCGTCAACTGATAAT<br>TTTAATAAGGAGATTTTGTTAGATAGATCTGCTGGTCA<br>AAATGGTGCCTTTAAAATCAAATTGGACTACGTTAAGgaaCC<br>TATTCCAGAATCCGTCTTTGTTCAAATTTTGGAGAAGTT<br>ATACGAAGAAGATATTGGTGCTGGTATGTACGCCTTG<br>TATCCATATGGTGGTATTATGGATGAAATTTCTGAATCCGCCATC<br>CCTTTCCCTCATCGTGCTGGTATCTTATACGAGTTGTGGTACATC<br>TGTTCTTGGGAAAAGCAAGAAGATAATGAAAAGCATTTGAACT<br>GGATCCGTAACATCTATAACTTCATGACTCCATACGTTTCCAAA<br>AACCCTAGATTGGCTTACTTAAATTACAGAGACTTAGAT<br>ATTGGTATTAACGACCCTAAGAACCCAAACAATTACA<br>CTCAAGCTAGAATCTGGGGTGAAAAGTACTTCGGTAAGAATTTCG<br>ACAGATTAGTTAAGGTCAAGACTTTAGTTGACCCAAATAACTTCT<br>TCAGAAACGAACAATCTATCCCACCATTGCCTAGACATAGACACT<br>AG |
| SEQ ID NO: 202<br>CBDA Synthase,<br>K389E variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSH<br>VSHIQGTILCSKKVGLQIRTRSGGHDSEGMSYISQVPFVIVD<br>LRNMRSIKIDVHSQTAWVEAGATLGEVYYWVNEKNENLSLAAG<br>YCPTVCAGGHFGGGGYGPLMRNYGLAADNIIDAHLVNVHGKVLD<br>RKSMGEDLFWALRGGGAESFGIIVAWKIRLVAVPKSTMFSVKKIM<br>EIHELVKLVNKWQNIAYKYDKDLLLMTHFITRNITDNQGKNKTAI<br>HTYFSSVFLGGVDSLVDLMNKSFPELGIKKTDCRQLSWIDTIIFY<br>SGVVNYDTDNFNKEILLDRSAGQNGAFKIKLDYVKEPIPESVFVQ<br>ILEKLYEEDIGAGMYALYPYGGIMDEISESAIPFPHRAGILYELW<br>YICSWEKQEDNEKHLNWIRNIYNFMTPYVSKNPRLAYLNYRDLDI<br>GINDPKNPNNYTQARIWGEKYFGKNFDRLVKVKTLVDPNNFFRNE<br>QSIPPLPRHRH* |
| SEQ ID NO: 203<br>CBDA Synthase,<br>E406K variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGA<br>AATATGCGTTCCATCAAGATTGATGTCCATTCCCAAACTGCTT<br>GGGTTGAAGCCGGTGCCACTTTAGGTGAAGTCTATTACTGGGTTA<br>ACGAGAAGAATGAGAACTTATCTTTGGCTGCCGGTTACTGTCCAA<br>CTGTTTGTGCTGGTGGTCATTTCGGTGGTGGTGGTTACGGTCCAT<br>TAATGCGTAACTACGGTTTGGCTGCCGATAACATCATTGATGCCC<br>ACTTAGTCAACGTTCATGGTAAGGTCTTGGACCGTAAGTCTATGG<br>GTGAGGATTTATTCTGGGCTTTGAGAGGTGGTGGTGCTGAATCTT<br>TCGGTATTATCGTCGCTTGGAAGATTAGATTAGTTGCTGTT<br>CCAAAGTCTACTATGTTCTCTGTTAAGAAGATCATGGAAA<br>TTCACGAGTTGGTTAAATTAGTTAACAAATGGCAAAACATTGCCT<br>ACAAGTACGATAAAGATTTGTTATTAATGACTCACTTTATCACT<br>AGAAACATTACTGATAACCAAGGTAAGAATAAGA<br>CTGCCATTCACACTTACTTCTCTTCTGTTTTCTTGGGTGGTGTTG |

TABLE 1-continued

| Amino acid and nucleotide sequences of the disclosure | |
|---|---|
| | ATTCCTTGGTCGATTTGATGAACAAGTCTTTTCCAGAATTAGGTA<br>TTAAGAAGACCGATTGTCGTCAACTGATAATTrTAATAAGGAGAT<br>TTTGTTAGATAGATCTGCTGGTCAAAATGGTGCCTTTAAAATCAA<br>ATTGGACTACGTTAAGAAGCCTATTCCAGAATCCGTCTTTGTTC<br>AAATTTTGGAGAAGTTATACGAAaaaGATATTGGTGC<br>TGGTATGTACGCCTTGTATCCATATGGTGGTATTATGGATGAA<br>ATTTCTGAATCCGCCATCCCTTTCCCTCATCGTGCTGGTATCTTA<br>TACGAGTTGTGGTACATCTGTTCTTGGGAAAAGCAAGAAGATAAT<br>GAAAAGCATTTGAACTGGATCCGTAACATCTATAACTTCATGACT<br>CCATACGTTTCCAAAAACCCTAGATTGGCTTACTTAAATTAC<br>AGAGACTTAGATATTGGTATTAACGACCCTAAGAACC<br>CAAACAATTACACTCAAGCTAGAATCTGGGGTGAAAAGTACTT<br>CGGTAAGAATTTCGACAGATTAGTTAAGGTCAAGACTTT<br>AGTTGACCCAAATAACTTCTTCAGAAACGAACAATCT<br>ATCCCACCATTGCCTAGACATAGACACTAG |
| SEQ ID NO: 204<br>CBDA Synthase,<br>E406K variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSH<br>VSHIQGTILCSKKVGLQIRTRSGGHDSEGMSYISQVPFVIVDLRN<br>MRSIKIDVHSQTAWVEAGATLGEVYYWVNEKNENLSLAAGYCP<br>TVCAGGHFGGGGYGPLMRNYGLAADNIIDAHLVNVHGKVLDRKS<br>MGEDLFWALRGGGAESFGIIVAWKIRLVAVPKSTMFSVKKIMEIH<br>ELVKLVNKWQNIAYKYDKDLLLMTHFITRNITDNQGKNKTAIHTY<br>FSSVFLGGVDSLVDLMNKSFPELGIKKTDCRQLSWIDTIIFYSGV<br>VNYDTDNFNKEILLDRSAGQNGAFKIKLDYVKKPIPESVFVQILE<br>KLYEKDIGAGMYALYPYGGIMDEISESAIPFPHRAGILYELWYIC<br>SWEKQEDNEKHLNWIRNIYNFMTPYVSKNPRLAYLNYRDLDIGIN<br>DPKNPNNYTQARIWGEKYFGKNFDRLVKVKTLVDPNNFFRNEQSI<br>PPLPRHRH* |
| SEQ ID NO: 205<br>CBDA Synthase,<br>S428L variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCA<br>TTATATATGTCTGTCTTAAACTCTACCATTCACAACT<br>TACGTTTCACTTCTGATACTACTCCAAAACCTTTGGTCATCGTCA<br>CCCCATCCCACGTTTCTCACATCCAAGGTACCATCTTGTGTTCCA<br>AAAAGGTTGGTTTACAAATCCGTACTAGATCCGGTGGTC<br>ATGACTCCGAAGGTATGTCTTACATTTCCCAAGTCCCTTTC<br>GTCATCGTCGACTTAAGAAATATGCGTTCCATCAAGATTGATGTC<br>CATTCCCAAACTGCTTGGGTTGAAGCCGGTGCCACTTTAGGTGA<br>AGTCTATTACTGGGTTAACGAGAAGAATGAGAACTTATCTTTGG<br>CTGCCGGTTACTGTCCAACTGTTTGTGCTGGTGGTCATTTCGGTG<br>GTGGTGGTTACGGTCCATTAATGCGTAACTACGGTTTGGCTGCC<br>GATAACATCATTGATGCCCACTTAGTCAACGTTCATGGTAAGGT<br>CTTGGACCGTAAGTCTATGGGTG<br>AGGATTTATTCTGGGCTTTGAGAGGTGGTGGTGCTGAATCTTTCG<br>GTATTATCGTCGCTTGGAAGATTAGATTAGTTGCTGTTCCAAAGT<br>CTACTATGTTCTCTGTTAAGAAGATCATGGAAATTCACGAGTTGG<br>TTAAATTAGTTAACAAATGGCAAAACATTGCCTACAA<br>GTACGATAAAGATTTGTTATTAATGACTCACTTTATC<br>ACTAGAAACATTACTGATAACCAAGGTAAGAATAAGACTGCCATT<br>CACACTTACTTCTCTTCTGTTTTCTTGGGTGGTGTTGATTCCTTG<br>GTCGATTTGATGAACAAGTCTTTTCCAGAATTAGGTATTAAGAAG<br>ACCGATTGTCGTCAACTGATAATTTTAATAAGGAGATTTTGTTAG<br>ATAGATCTGCTGGTCAAAATGGTGCCTTTAAAATCAAATTGGACT<br>ACGTTAAGAAGCCTATTCCAGAATCCGTCTTTGTTCAAATTTTGG<br>AGAAGTTATACGAAGAAGATATTGGTGCTGGTATGTACGCCTTGT<br>ATCCATATGGTGGTATTATGGATGAAATTTCTGAAttgGCCATCC<br>CTTTCCCTCATCGTGCTGGTATCTTATACGAGTTGTGGTACATCT<br>GTTCTTGGGAAAAGCAAGAAGATAATGAAAAGCATTTGAACTGGA<br>TCCGTAACATCTATAACTTCATGACTCCATACGTTTCCA<br>AAAACCCTAGATTGGCTTACTTAAATTACAGAGACTTAG<br>ATATTGGTATTAACGACCCTAAGAACCCAAACAATTACACTCAAG<br>CTAGAATCTGGGGTGAAAAGTACTTCGGTAAGAATTTCGACAGAT<br>TAGTTAAGGTCAAGACTTTAGTTGACCCAAATAACTTCTTCAGAA<br>ACGAACAATCTATCCCACCATTGCCTAGACATAGACACTAG |
| SEQ ID NO: 206<br>CBDA Synthase,<br>S428L variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSH<br>VSHIQGTILCSKKVGLQIRTRSGGHDSEGMSYISQVPFVIVDLRN<br>MRSIKIDVHSQTAWVEAGATLGEVYYVVVNEKNENLSLAAGYC<br>PTVCAGGHFGGGGYGPLMRNYGLAADNIIDAHLVNVHGK<br>VLDRKSMGEDLFVVALRGGGAESFGIIVAVVKIRLVAVPKSTMFS<br>VKKIMEIHELVKLVNKVVQNIAYKYDKDLLLMTHFITRNITDNQG<br>KNKTAIHTYFSSVFLGGVDSLVDLMNKSFPELGIKKTDCRQLSWI<br>DTIIFYSGVVNYDTDNFNKEILLDRSAGQNGAFKIKLDYVKKPIP<br>ESVFVQILEKLYEEDIGAGMYALYPYGGIMDEISELAIPFPHRAG |

TABLE 1-continued

| Amino acid and nucleotide sequences of the disclosure | |
|---|---|
| | ILYELWYICSWEKQEDNEKHLNWIRNIYNFMTPYVSKNPRLAYLN<br>YRDLDIGINDPKNPNNYTQARIWGEKYFGKNFDRLVKVKTLVDPN<br>NFFRNEQSIPPLPRHRH* |
| SEQ ID NO: 207<br>CBDA Synthase,<br>L439M variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCA<br>AATAACGCTACTAACTTGAAGTTAGTCTATACTCAAAAC<br>AACCCATTATATATGTCTGTCTTAAACTCTACCATTCACAACTTA<br>CGTTTCACTTCTGATACTACTCCAAAACCTTTGGTCATCGTCACC<br>CCATCCCACGTTTCTCACATCCAAGGTACCATCTTGTGTTCCAAA<br>AAGGTTGGTTTACAAATCCGTACTAGATCCGGTGGTCATGACTCC<br>GAAGGTATGTCTTACATTTCCCAAGTCCCTTTCGTCATCGTC<br>GACTTAAGAAATATGCGTTCCATCAAGATTGATGTCCATT<br>CCCAAACTGCTTGGGTTGAAGCCGGTGCCACTTTAGGTGAAGTCT<br>ATTACTGGGTTAACGAGAAGAATGAGAACTTATCTTTGGCTGCCG<br>GTTACTGTCCAACTGTTTGTGCTGGTGGTCATTTCGGTGGTGGTG<br>GTTACGGTCCATTAATGCGTAACTACGGTTTGGCTGCCGATAACA<br>TCATTGATGCCCACTTAGTCAACGTTCATGGTAAGGTCTTGGACC<br>GTAAGTCTATGGGTGAGGATTTATTCTGGGCTTTGAGAGGTGGTG<br>GTGCTGAATCTTTCGGTATTATCGTCGCTTGGAAGATTAGA<br>TTAGTTGCTGTTCCAAAGTCTACTATGTTCTCTGTTAAG<br>AAGATCATGGAAATTCACGAGTTGGTTAAATTAGTT<br>AACAAATGGCAAAACATTGCCTACAAGTACGAT<br>AAAGATTTGTTATTAATGACTCACTTTATCACTAG<br>AAACATTACTGATAACCAAGGTAAGAATAAG<br>ACTGCCATTCACACTTACTTCTCTTCTGTTTTCTTGGGTGGTGT<br>TGATTCCTTGGTCGATTTGATGAACAAGTCTTTTCCAGAATTAGG<br>TATTAAGAAGACCGATTGTCGTCAACTGATAATTTTAATA<br>AGGAGATTTTGTTAGATAGATCTGCTGGTCAAAATGGTG<br>CCTTTAAAATCAAATTGGACTACGTTAAGAAGCCTATTCCAGAAT<br>CCGTCTTTGTTCAAATTTTGGAGAAGTTATACGAAGAAGATATTG<br>GTGCTGGTATGTACGCCTTGTATCCATATGGTGGTATTATGGATG<br>AAATTTCTGAATCCGCCATCCCTTTCCCTCATCGTGCTGGTA<br>TCalgTACGAGTTGTGGTACATCTGTTCTTGGGAAAAGCAA<br>GAAGATAATGAAAAGCATTTGAACTGGATCCGTAACA<br>TCTATAACTTCATGACTCCATACGTTTCCAAAAACCCTAGATTGG<br>CTTACTTAAATTACAGAGACTTAGATATTGGTATT<br>AACGACCCTAAGAACCCAAACAATTACACTCAAGCTAGA<br>ATCTGGGGTGAAAAGTACTTCGGTAAGAATTT<br>CGACAGATTAGTTAAGGTCAAGACTTTAGTTGACCCAAATAACTT<br>CTTCAGAAACGAACAATCTATCCCACCATTGCCTAGACATAG<br>ACACTAG |
| SEQ ID NO: 208<br>CBDA Synthase,<br>L439M variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSH<br>VSHIQGTILCSKKVGLQIRTRSGGHDSEGMSYISQVPFVIVDLRN<br>MRSIKIDVHSQTAWVEAGATLGEVYYWVNEKNENLSLAAGYCP<br>TVCAGGHFGGGGYGPLMRNYGLAADNIIDAHLVNVHGKVLDRKSM<br>GEDLFWALRGGGAESFGIIVAWKIRLVAVPKSTMFSVKKIMEIHE<br>LVKLVNKVVQNIAYKYDKDLLLMTHFITRNITDNQGKNKTAIHTY<br>FSSVFLGGVDSLVDLMNKSFPELGIKKTDCRQLSWIDTIIFYSGW<br>NYDTDNFNKEILLDRSAGQNGAFKIKLDYVKKPIPESVFVQILEK<br>LYEEDIGAGMYALYPYGGIMDEISESAIPFPHRAGIMYELWYICS<br>WEKQEDNEKHLNWIRNIYNFMTPYVSKNPRLAYLNYRDLDIGIND<br>PKNPNNYTQARIWGEKYFGKNFDRLVKVKTLVDPNNFFRNEQSIP<br>PLPRHRH* |
| SEQ ID NO: 209<br>CBDA Synthase,<br>N466D variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCC<br>ATTATATATGTCTGTCTTAAACTCTACCATTCACAA<br>CTTACGTTTCACTTCTGATACTACTCCAAAACCTTTGG<br>TCATCGTCACCCCATCCCACGTTTCTCACATCCAAGGTACCAT<br>CTTGTGTTCCAAAAAGGTTGGTTTACAAATCCGTACTAGA<br>TCCGGTGGTCATGACTCCGAAGGTATGTCTTACATTTCCC<br>AAGTCCCTTTCGTCATCGTCGACTTAAGAAATATGCGTTCCATCA<br>AGATTGATGTCCATTCCCAAACTGCTTGGGTTGAAGCCGGTGCCA<br>CTTTAGGTGAAGTCTATTACTGGGTTAACGAGAAGAATGAGAACT<br>TATCTTTGGCTGCCGGTTACTGTCCAACTGTTTGTGCTGGTGGTC<br>ATTTCGGTGGTGGTGGTTACGGTCCATTAATGCGTAACTACGGTT<br>TGGCTGCCGATAACATCATTGATGCCCACTTAGTCAACGTTCATG<br>GTAAGGTCTTGGACCGTAAGTCTATGGGTGAGGATTTATTCTGGG<br>CTTTGAGAGGTGGTGGTGCTGAATCTTTCGGTATTATCGTCGCTT<br>GGAAGATTAGATTAGTTGCTGTTCCAAAGTCTACTATGTTCTCTG<br>TTAAGAAGATCATGGAAATTCACGAGTTGGTTAAATTAGTTAACA<br>AATGGCAAAACATTGCCTACAAGTACGATAA |

TABLE 1-continued

| Amino acid and nucleotide sequences of the disclosure | |
|---|---|
| | AGATTTGTTATTAATGACTCACTTTATCACTAGAAA<br>CATTACTGATAACCAAGGTAAGAATAAGACTGCCATTCACA<br>CTTACTTCTCTTCTGTTTTCTTGGGTGGTGTTGATTCCTTGGTCG<br>ATTTGATGAACAAGTCTTTTCCAGAATTAGGTATTA<br>AGAAGACCGATTGTCGTCAACTGATAATTTTAATAAGGAG<br>ATTTTGTTAGATAGATCTGCTGGTCAAAATGGTGCCTTTAAA<br>ATCAAATTGGACTACGTTAAGAAGCCTATTCCAGA<br>ATCCGTCTTTGTTCAAATTTTGGAGAAGTTATACGAAGAAGATAT<br>TGGTGCTGGTATGTACGCCTTGTATCCATATGGTGGTATTATGGA<br>TGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATgatTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |
| SEQ ID NO: 210<br>CBDA Synthase,<br>N466D variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSH<br>VSHIQGTILCSKKVGLQIRTRSGGHDSEGMSYISQVPFVIVDLRN<br>MRSIKIDVHSQTAWVEAGATLGEVYYWVNEKNENLSLAAGYCPT<br>VCAGGHFGGGGYGPLMRNYGLAADNIIDAHLVNVHGKVLDRKSM<br>GEDLFVVALRGGGAESFGIIVAVVKIRLVAVPKSTMFSVKKIMEI<br>HELVKLVNKWQNIAYKYDKDLLLMTHFITRNITDNQGKNKTAIHT<br>YFSSVFLGGVDSLVDLMNKSFPELGIKKTDCRQLSWIDTIIFYSG<br>VVNYDTDNFNKEILLDRSAGQNGAFKIKLDYVKKPIPESVFVQIL<br>EKLYEEDIGAGMYALYPYGGIMDEISESAIPFPHRAGILYELWYI<br>CSWEKQEDNEKHLNVVIRNIYDFMTPYVSKNPRLAYLNYRDLDIG<br>INDPKNPNNYTQARIWGEKYFGKNFDRLVKVKTLVDPNNFFRNEQ<br>SIPPLPRHRH* |
| SEQ ID NO: 211<br>CBDA Synthase,<br>K474S variant | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCA<br>AATAACGCTACTAACTTGAAGTTAGTCTATACTCAAAA<br>CAACCCATTATATATGTCTGTCTTAAACTCTACCATTCACAACTT<br>ACGTTTCACTTCTGATACTACTCCAAAACCTTTGGTCATC<br>GTCACCCC |
| Artificial Sequence<br>Codon optimized | ATCCCACGTTTCTCACATCCAAGGTACCATCTTGTGTTCCAAAAA<br>GGTTGGTTTACAAATCCGTACTAGATCCGGTGGTCATGACTCCGA<br>AGGTATGTCTTACATTTCCCAAGTCCCTTTCGTCATCGTCGACTT<br>AAGAAATATGCGTTCCATCAAGATTGATGTCCATTCCCAAACTGC<br>TTGGGTTGAAGCCGGTGCCACTTTAGGTGAAGTCTATTACTGGGT<br>TAACGAGAAGAATGAGAACTTATCTTTGGCTGCCGGTTACTGTCC<br>AACTGTTTGTGCTGGTGGTCATTTCGGTGGTGGTGGTTACGGTCC<br>ATTAATGCGTAACTACGGTTTGGCTGCCGATAACATCATTGATGC<br>CCACTTAGTCAACGTTCATGGTAAGGTCTTGGACCGTAAGTCTAT<br>GGGTGAGGATTTATTCTGGGCTTTGAGAGGTGGTGGTGCTGAATC<br>TTTCGGTATTATCGTCGCTTGGAAGATTAGATTAGTTGCTGTTCC<br>AAAGTCTACTATGTTCTCTGTTAAGAAGATCATGGAAATTCACGA<br>GTTGGTTAAATTAGTTAACAAATGGCAAAACATTGCCTACAAGTA<br>CGATAAAGATTTGTTATTAATGACTCACTTTATCACTAGAAACAT<br>TACTGATAACCAAGGTAAGAATAAGACTGCCATTCACACTTACTT<br>CTCTTCTGTTTTCTTGGGTGGTGTTGATTCCTTGGTCGATTTGAT<br>GAACAAGTCTTTTCCAGAATTAGGTATTAAGAAGACCGATTGTCG<br>TCAACTGATAATTTTAATAAGGAGATTTTGTTAGATAGATCTGCT<br>GGTCAAAATGGTGCCTTTAAAATCAAATTGGACTACGTTAAGAAG<br>CCTATTCCAGAATCCGTCTTTGTTCAAATTTTGGAGAAGTTATAC<br>GAAGAAGATATTGGTGCTGGTATGTACGCCTTGTATCCATATGGT<br>GGTATTATGGATGAAATTTCTGAATCCGCCATCCCTTTCCCTCAT<br>CGTGCTGGTATCTTATACGAGTTGTGGTACATCTGTTCTTGGGAA<br>AAGCAAGAAGATAATGAAAAGCATTTGAACTGGATCCGTAACATC<br>TATAACTTCATGACTCCATACGTTTCCtctAACCCTAGATTGGCT<br>TACTTAAATTACAGAGACTTAGATATTGGTATTAACGACCCTAAG<br>AACCCAAACAATTACACTCAAGCTAGAATCTGGGGTGAAAAGTAC<br>TTCGGTAAGAATTTCGACAGATTAGTTAAGGTCAAGACTTTAGTT<br>GACCCAAATAACTTCTTCAGAAACGAACAATCTATCCCACCATTG<br>CCTAGACATAGACACTAG |
| SEQ ID NO: 212<br>CBDA Synthase,<br>K474S variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV |

TABLE 1-continued

| Amino acid and nucleotide sequences of the disclosure | |
|---|---|
| | FLGGVDSLVDLMNKSFPELGIKKTDCRQLSWIDTIIFYSGWNYDT<br>DNFNKEILLDRSAGQNGAFKKLDYVKKPIPESVFVQILEKLYEED<br>IGAGMYALYPYGGIMDEISESAIPFPHRAGILYELWYICSWEKQE<br>DNEKHLNWIRNIYNFMTPYVSSNPRLAYLNYRDLDIGINDPKNPN<br>NYTQARIWGEKYFGKNFDRLVKVKTLVDPNNFFRNEQSIPPLPRH<br>RH* |
| SEQ ID NO: 213<br>CBDA Synthase,<br>Y499M variant<br>Artificial Sequence<br>Codon optimized | ATGAAATGCTCCACTTTCTCTTTCTGGTTCGTTTGTAAGATTATC<br>TTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAACTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATatgACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |
| SEQ ID NO: 214<br>CBDA Synthase,<br>Y499M variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKIKLDYVKKPIPESVFVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP<br>NNMTQARIWGEKYFGKNFDRLVKVKTLVDPNNFFRNEQSIPPLPR<br>HRH* |
| SEQ ID NO: 215<br>CBDA Synthase,<br>Y499V variant<br>Artificial Sequence<br>Codon optimized | ATGAAATGCTCCACTTTCTCTTTCTGGTTCGTTTGTAAGATTATC<br>TTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC |

TABLE 1-continued

| Amino acid and nucleotide sequences of the disclosure | |
|---|---|
| | CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAACTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATgttACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |
| SEQ ID NO: 216<br>CBDA Synthase,<br>Y499V variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGVVNYD<br>TDNFNKEILLDRSAGQNGAFKKLDYVKKPIPESVFVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP<br>NNVTQARIWGEKYFGKNFDRLVKVKTLVDPNNFFRNEQSIPPLPR<br>HRH* |
| SEQ ID NO: 217<br>CBDA Synthase,<br>N527E variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAACTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAgaaA<br>ACTTCTTCAGAAACGAACAATCTATCCCACCATTGCCTAGACATA<br>GACACTAG |
| SEQ ID NO: 218<br>CBDA Synthase,<br>N527E variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKIKLDYVKKPIPESVFVQILEKLYEE<br>DIGAGMYALYPYGGIMDEISESAIPFPHRAGILYELWYICSWEKQ |

TABLE 1-continued

| Amino acid and nucleotide sequences of the disclosure | |
|---|---|
| | EDNEKHLNWIRNIYNFMTPYVSKNPRLAYLNYRDLDIGINDPKNP<br>NNYTQARIWGEKYFGKNFDRLVKVKTLVDPENFFRNEQSIPPLPR<br>HRH* |
| SEQ ID NO: 219<br>CBDA Synthase,<br>P538T variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATG<br>GCAAAACATTGCCTACAAGTACGATAAAGATTTGTTATTAATGAC<br>TCACTTTATCACTAGAAACATTACTGATAACCAAGGTAAGAATAA<br>GACTGCCATTCACACTTACTTCTCTTCTGTTTTCTTGGGTGGTGT<br>TGATTCCTTGGTCGATTTGATGAACAAGTCTTTTCCAGAATTAGG<br>TATTAAGAAGACCGATTGTCGTCAACTGATAATTTTAATAAGGAG<br>ATTTTGTTAGATAGATCTGCTGGTCAAAATGGTGCCTTTAAAATC<br>AAATTGGACTACGTTAAGAAGCCTATTCCAGAATCCGTCTTTGTT<br>CAAATTTTGGAGAAGTTATACGAAGAAGATATTGGTGCTGGTATG<br>TACGCCTTGTATCCATATGGTGGTATTATGGATGAAATTTCTGAA<br>TCCGCCATCCCTTTCCCTCATCGTGCTGGTATCTTATACGAGTTG<br>TGGTACATCTGTTCTTGGGAAAAGCAAGAAGATAATGAAAAGCAT<br>TTGAACTGGATCCGTAACATCTATAACTTCATGACTCCATACGTT<br>TCCAAAAACCCTAGATTGGCTTACTTAAATTACAGAGACTTAGAT<br>ATTGGTATTAACGACCCTAAGAACCCAAACAATTACACTCAAGCT<br>AGAATCTGGGGTGAAAAGTACTTCGGTAAGAATTTCGACAGATTA<br>GTTAAGGTCAAGACTTTAGTTGACCCAAATAACTTCTTCAGAAAC<br>GAACAATCTATCCCAactTTGCCTAGACATAGACACTAG |
| SEQ ID NO: 220<br>CBDA Synthase,<br>P538T variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKVVQNIAYKYDKDLLLMTHFITRNITDNQGKNKTAIHTYFSS<br>VFLGGVDSLVDLMNKSFPELGIKKTDCRQLSWIDTIIFYSGWNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPTLP<br>RHRH* |
| SEQ ID NO: 221<br>CBDA Synthase,<br>R541E variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAACTGATA |

TABLE 1-continued

| Amino acid and nucleotide sequences of the disclosure | |
|---|---|
| | ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTgaaCATA<br>GACACTAG |
| SEQ ID NO: 222<br>CBDA Synthase,<br>R541E variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGVVNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>EHRH* |
| SEQ ID NO: 223<br>CBDA Synthase,<br>R541V variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAACTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTgttCATA<br>GACACTAG |
| SEQ ID NO: 224<br>CBDA Synthase,<br>R541V variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKVVQNIAYKYDKDLLLMTHFITRNITDNQGKNKTAIHTYFSS<br>VFLGGVDSLVDLMNKSFPELGIKKTDCRQLSWIDTIIFYSGWNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>VHRH* |

TABLE 1-continued

| Amino acid and nucleotide sequences of the disclosure | |
|---|---|
| SEQ ID NO: 225<br>CBDA Synthase<br>H542V variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGAgttAGACACTAG |
| SEQ ID NO: 226<br>CBDA Synthase,<br>H542V variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKVVQNIAYKYDKDLLLMTHFITRNITDNQGKNKTAIHTYFSS<br>VFLGGVDSLVDLMNKSFPELGIKKTDCRQLSWIDTIIFYSGWNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>RVRH* |
| SEQ ID NO: 227<br>CBDA Synthase,<br>R543A variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT |

TABLE 1-continued

| Amino acid and nucleotide sequences of the disclosure | |
|---|---|
| | CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATgctCACTAG |
| SEQ ID NO: 228<br>CBDA Synthase,<br>R543A variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYVVVNEKNENLSLAAGYCPTV<br>CAGGHFGGGGYGPLMRNYGLAADNIIDAHLVNVHGKVLDRKSMGE<br>DLFWALRGGGAESFGIIVAWKIRLVAVPKSTMFSVKKIMEIHELV<br>KLVNKWQNIAYKYDKDLLLMTHFITRNITDNQGKNKTAIHTYFSS<br>VFLGGVDSLVDLMNKSFPELGIKKTDCRQLSWIDTIIFYSGWNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>RHAH* |
| SEQ ID NO: 229<br>CBDA Synthase,<br>R543E variant<br>Artificial Sequence<br>Codon optimized | ATGAAATGCTCCACTTTCTC'TTTCTGGTTCGTTTGTAAGATTAT<br>CTTCTTCTTCTTTTCTTTCAACATCCAAACTTCCATTGCCAACCC<br>TCGTGAGAACTTCTTGAAATGTTTTTCTCAATATATCCCAAATAA<br>CGCTACTAACTTGAAGTTAGTCTATACTCAAAACAACCCATTATA<br>TATGTCTGTCTTAAACTCTACCATTCACAACTTACGTTTCACTTC<br>TGATACTACTCCAAAACCTTTGGTCATCGTCACCCCATCCCACGT<br>TTCTCACATCCAAGGTACCATCTTGTGTTCCAAAAAGGTTGGTTT<br>ACAAATCCGTACTAGATCCGGTGGTCATGACTCCGAAGGTATGTC<br>TTACATTTCCCAAGTCCCTTTCGTCATCGTCGACTTAAGAAATAT<br>GCGTTCCATCAAGATTGATGTCCATTCCCAAACTGCTTGGGTTGA<br>AGCCGGTGCCACTTTAGGTGAAGTCTATTACTGGGTTAACGAGAA<br>GAATGAGAACTTATCTTTGGCTGCCGGTTACTGTCCAACTGTTTG<br>TGCTGGTGGTCATTTCGGTGGTGGTGGTTACGGTCCATTAATGCG<br>TAACTACGGTTTGGCTGCCGATAACATCATTGATGCCCACTTAGT<br>CAACGTTCATGGTAAGGTCTTGGACCGTAAGTCTATGGGTGAGGA<br>TTTATTCTGGGCTTTGAGAGGTGGTGGTGCTGAATCTTTCGGTAT<br>TATCGTCGCTTGGAAGATTAGATTAGTTGCTGTTCCAAAGTCTAC<br>TATGTTCTCTGTTAAGAAGATCATGGAAATTCACGAGTTGGTTAA<br>ATTAGTTAACAAATGGCAAAACATTGCCTACAAGTACGATAAAGA<br>TTTGTTATTAATGACTCACTTTATCACTAGAAACATTACTGATAA<br>CCAAGGTAAGAATAAGACTGCCATTCACACTTACTTCTCTTCTGT<br>TTTCTTGGGTGGTGTTGATTCCTTGGTCGATTTGATGAACAAGTC<br>TTTTCCAGAATTAGGTATTAAGAAGACCGATTGTCGTCAATTATC<br>TTGGATTGATACCATTATTTTTTACTCCGGTGTTGTCAACTACGA<br>CACTGATAATTTTAATAAGGAGATTTTGTTAGATAGATCTGCTGG<br>TCAAAATGGTGCCTTTAAAATCAAATTGGACTACGTTAAGAAGCC<br>TATTCCAGAATCCGTCTTTGTTCAAATTTTGGAGAAGTTATACGA<br>AGAAGATATTGGTGCTGGTATGTACGCCTTGTATCCATATGGTGG<br>TATTATGGATGAAATTTCTGAATCCGCCATCCCTTTCCCTCATCG<br>TGCTGGTATCTTATACGAGTTGTGGTACATCTGTTCTTGGGAAAA<br>GCAAGAAGATAATGAAAAGCATTTGAACTGGATCCGTAACATCTA<br>TAACTTCATGACTCCATACGTTTCCAAAAACCCTAGATTGGCTTA<br>CTTAAATTACAGAGACTTAGATATTGGTATTAACGACCCTAAGAA<br>CCCAAACAATTACACTCAAGCTAGAATCTGGGGTGAAAAGTACTT<br>CGGTAAGAATTTCGACAGATTAGTTAAGGTCAAGACTTTAGTTGA<br>CCCAAATAACTTCTTCAGAAACGAACAATCTATCCCACCATTGCC<br>TAGACATgaaCACTAG |
| SEQ ID NO: 230<br>CBDA Synthase,<br>R543E variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKIKLDYVKKPIPESVFVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP<br>NNYTQARIWGEKYFGKNFDRLVKVKTLVDPNNFFRNEQSIPPLPR<br>HEH* |

TABLE 1-continued

| Amino acid and nucleotide sequences of the disclosure | |
|---|---|
| SEQ ID NO: 231<br>CBDA Synthase,<br>H544E variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAACTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GAgaaTAG |
| SEQ ID NO: 232<br>CBDA Synthase,<br>H544E variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKIKLDYVKKPIPESVFVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP<br>NNYTQARIWGEKYFGKNFDRLVKVKTLVDPNNFFRNEQSIPPLPR<br>HRE* |
| SEQ ID NO: 233<br>CBDA Synthase,<br>H544D variant<br>Artificial Sequence<br>Codon optimized | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAACTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA |

TABLE 1-continued

| Amino acid and nucleotide sequences of the disclosure | |
|---|---|
| | TTGGTGCTGGTATGTACGCCTTGTATCCATATGGTGGTATTATGG ATGAAATTTCTGAATCCGCCATCCCTTTCCCTCATCGTGCTGGTA TCTTATACGAGTTGTGGTACATCTGTTCTTGGGAAAAGCAAGAAG ATAATGAAAAGCATTTGAACTGGATCCGTAACATCTATAACTTCA TGACTCCATACGTTTCCAAAAACCCTAGATTGGCTTACTTAAATT ACAGAGACTTAGATATTGGTATTAACGACCCTAAGAACCCAAACA ATTACACTCAAGCTAGAATCTGGGGTGAAAAGTACTTCGGTAAGA ATTTCGACAGATTAGTTAAGGTCAAGACTTTAGTTGACCCAAATA ACTTCTTCAGAAACGAACAATCTATCCCACCATTGCCTAGACATA GAgatTAG |
| SEQ ID NO: 234<br>CBDA Synthase,<br>H544D variant<br>Artificial Sequence | MKCSTFSFWFVCKIIFFFFSFNIQTSIANPRENFLKCFSQYIPNN ATNLKLVYTQNNPLYMSVLNSTIHNLRFTSDTTPKPLVIVTPSHV SHIQGTILCSKKVGLQIRTRSGGHDSEGMSYISQVPFVIVDLRNM RSIKIDVHSQTAWVEAGATLGEVYYWVNEKNENLSLAAGYCPTVC AGGHFGGGGYGPLMRNYGLAADNIIDAHLVNVHGKVLDRKSMGED LFWALRGGGAESFGIIVAWKIRLVAVPKSTMFSVKKIMEIHELVK LVNKWQNIAYKYDKDLLLMTHFITRNITDNQGKNKTAIHTYFSSV FLGGVDSLVDLMNKSFPELGIKKTDCRQLSWIDTIIFYSGVVNYD TDNFNKEILLDRSAGQNGAFKIKLDYVKKPIPESVFVQILEKLYE EDIGAGMYALYPYGGIMDEISESAIPFPHRAGILYELWYICSWEK QEDNEKHLNVVIRNIYNFMTPYVSKNPRLAYLNYRDLDIGINDPK NPNNYTQARIWGEKYFGKNFDRLVKVKTLVDPNNFFRNEQSIPPL PRHRD* |
| SEQ ID NO: 293<br>Artificial aromatic<br>prenyltransferase<br>(NphB-ScCO)<br>nucleotide sequence | ATGTCTGAGGCGGCAGACGTAGAGAGAGTATACGCTGCTATGGAG GAAGCGGCTGGATTATTGGGGGTGGCTTGTGCCAGAGACAAGATA TATCCGTTACTGTCTACTTTCCAGGACACTCTTGTAGAAGGAGGG AGTGTGGTGGTGTTTAGTATGGCATCAGGCCGTCATTCAACAGAG CTAGATTTCAGTATATCTGTGCCAACAAGTCACGGTGATCCATAC GCAACCGTAGTCGAGAAGGGTCTTTTCCCGGCAACAGGGCATCCT GTAGATGATTTGCTTGCCGACACACAGAAGCACCTGCCCGTCTCC ATGTTCGCAATCGATGGTGAGGTGACCGGAGGATTTAAAAAGACT TACGCTTTCTTCCCGACTGACAATATGCCAGGAGTTGCCGAGTTG AGTGCAATACCATCCATGCCGCCAGCAGTCGCGGAGAACGCCGAA TTGTTCGCCCGTTACGGCTTGGACAAAGTCCAAATGACTAGTATG GACTATAAAAAGAGGCAGGTGAATCTATATTTCAGCGAACTTTCT GCCCAAACCTTGGAGGCGGAGAGCGTTTTAGCCCTTGTTAGGGAG TTAGGGCTACACGTCCCGAATGAGTTGGGTTTGAAATTTTGTAAG CGTAGCTTTTCAGTATATCCGACGCTGAACTGGGAAACTGGAAAG ATTGACAGGCTATGCTTTGCAGTGATTTCTAATGACCCTACGCTT GTACCTTCCTCAGACGAGGGCGACATCGAGAAATTCCACAACTAT GCCACAAAAGCTCCGTATGCCTACGTCGGCGAAAAACGTACTCTA GTATACGGTTTGACTCTGAGTCCCAAGGAAGAGTATTACAAGCTA GGAGCGTACTATCATATCACTGATGTGCAACGTGGCTTGCTGAAA GCCTTCGACTCCTTAGAGGAC |
| SEQ ID NO: 294<br>Aromatic<br>prenyltransferase<br>NphB-ScCO<br>(*Streptomyces* sp.) | MSEAADVERVYAAMEEAAGLLGVACARDKIYPLLSTFQDTLVEGG SVWFSMASGRHSTELDFSISVPTSHGDPYATVVEKGLFPATGHPV DDLLADTQKHLPVSMFAIDGEVTGGFKKTYAFFPTDNMPGVAELS AIPSMPPAVAENAELFARYGLDKVQMTSMDYKKRQVNLYFSELSA QTLEAESVLALVRELGLHVPNELGLKFCKRSFSVYPTLNWETGKI DRLCFAVISNDPTLVPSSDEGDIEKFHNYATKAPYAYVGEKRTLV YGLTLSPKEEYYKLGAYYHITDVQRGLLKAFDSLED |
| SEQ ID NO: 295<br>IREI fragment<br>Artificial Sequence | ATGCGGTCTACTTCGAAGAAACATGTTAGTATTGACACTGCTCGT TTGTGTGTTTTCATCCATCATTTCATGCTCAATCCCATTGTCGTC TCGCACCTCAAGGCGGCAGATAGTGGAAGATGAAGTTGCCTCCAC TAAAAAGCTCAATTTCAACTATGGTGTGGATAAAAATATAAACTC GCCCATTCCTGCTCCAAGAACCACTGAAGGTTTACCAAATATGAA ACTCAGCTCATATCCAACTCCTAACTTATTGAATACTGCTGATAA TCGACGTGCTAACAAAAAAGGACGTAGGGCTGCCAATTCTATAAG TGTACCCTATTTGGAGAATCGTTCCTTGAACGAACTGAGTTTATC AGATATACTAATCGCAGCCGACGTTGAGGGTGGACTTCATGCTGT AGATAGAAGAAATGGTCATATCATATGGTCAATCGAACCAGAAAA TTTTCAACCTCTGATAGAAATACAAGAACCTTCGAGGTTAGAAAC ATATGAAACGTTGATTATAGAACCTTTCGGTGATGGGAACATTTA CTACTTTAACGCCCATCAAGGGTTACAAAAACTGCCTTTATCCAT ACGACAACTTGTATCAACTTCCCCGCTGCACTTGAAAACAAATAT TGTGGTTAATGACTCTGGAAAAATTGTTGAAGATGAAAAGGTCTA CACTGGATCGATGAGAACTATAATGTATACTATAAACATGTTGAA TGGTGAAATTATATCAGCGTTCGGACCTGGTTCAAAAAACGGGTA TTTCGGGAGCCAGAGTGTGGATTGCTCACCTGAGGAGAAGATAAA ACTTCAGGAATGTGAAAATATGATTGTAATAGGCAAAACTATTTT TGAGCTGGGAATTCACTCTTATGATGGAGCAAGCTACAATGTCAC TTACTCTACATGGCAGCAAAATGTTTTAGATGTTCCCCTAGCGCT TCAGAATACATTTTCAAAGGACGGCATGTGCATAGCGCCTTTCCG TGATAAATCATTGCTAGCAAGCGATTTAGATTTTAGAATTGCTAG |

TABLE 1-continued

| Amino acid and nucleotide sequences of the disclosure | |
|---|---|
| | ATGGGTTTCTCCGACATTCCCCGGAATTATTGTTGGGCTTTTCGA TGTGTTTAATGATCTCCGCACCAATGAAAATATACTGGTACCGCA TCCCTTTAATCCTGGTGATCATGAAAGTATATCGAGTAACAAAGT TTACTTGGATCAGACTTCGAACCTCTCCTGGTTTGCATTATCTAG TCAGAATTTTCCATCTTTAGTCGAATCAGCTCCCATATCAAGATA CGCTTCCAGTGACCGTTGGAGGGTGTCTTCAATTTTTGAAGATGA GACTTTATTCAAGAACGCAATCATGGGTGTTCATCAGATATATAA TAATGAATATGATCACCTTTATGAAAACTATGAAAAAACGAATAG TTTGGACACTACGCACAAATATCCACCTCTGATGATTGATTCGTC CGTTGATACAACCGATTTACATCAGAATAACGAGATGAATTCACT AAAGGAATACATGTCACCAGAAGACCTTGAGGCATATAGAAAAAA GATACACGAGCAAATATCGAGAGAATTAGATGAAAAGAACCAAAA TTCTTTGCTACTGAAGTTTGGAAGTCTAGTATATCGAATTATAGA GACTGGAGTATTTCTGTTGTTATTTCTCATTTTTTGTGCAATACT ACAAAGATTCAAAATTTTGCCGCCACTATATGTATTATTATCCAA AATTGGATTTATGCCTGAAAAGGAAATCCCCATAGTTGAGTCGAA ATCGCTAAATTGTCCCTCTTCATCGGAAAATGTAACCAAGCCATT CGATATGAAATCAGGGAAGCAAGTTGTTTTTGAAGGTGCTGTGAA CGATGGAAGTCTAAAATCTGAAAAAGATAACGATGATGCTGATGA AGATGATGAAAAATCACTAGATTTAACCACAGAAAAGAAGAAGAG GAAAAGAGGTTCGAGAGGAGGCAAAAAGGGCCGAAAATCACGCAT TGCAAATATACCAAACTTTGAGCAATCTTTAAAAAATTTGGTAGT ATCCGAAAAAATTTTAGGTTACGGTTCATCAGGAACAGTAGTTTT TCAGGGAAGTTTTCAAGGAAGACCTGTTGCGGTAAAGAGAATGTT AATTGATTTTTGTGACATAGCTTTAATGGAAATAAAACTTTTGAC TGAAAGCGATGATCACCCTAACGTCATACGATACTACTGTTCAGA AACAACAGACAGATTTTTGTATATTGCTTTAGAGCTCTGCAATTT GAACCTTCAAGATTTGGTGGAGTCTAAGAATGTATCAGATGAAAA CCTGAAATTACAGAAAGAGTATAATCCAATTTCGTTATTGAGACA AATAGCGTCCGGGGTAGCACATTTACATTCTTTAAAGATTATCCA TCGAGATTTAAAGCCTCAAAATATTCTCGTTTCTACTTCGAGTAG GTTTACTGCCGATCAGCAAACAGGAGCAGAAAATCTTCGAATTTT GATATCAGACTTTGGTCTTTGCAAAAAACTAGACTCTGGTCAGTC TTCATTTAGAACAAATTTGAATAACCCTTCTGGCACAAGTGGTTG GAGGGCCCCAGAGCTGCTTGAAGAATCAAACAATTTGCAGTGCCA AGTCGAAACGGAACACTCTTCTAGTAGGCATACAGTAGTTTCATC TGATTCTTTTTATGATCCGTTCACCAAGAGGAGGCTAACAAAGGG AAGCATCCATTTGGAGATAAATATTCACGTGAAAGCAATATCATA AGAGGAATATTCAGTCTTGATGAAATGAAATGTCTACATGATAGA TCCTTAATTGCAGAAGCTACAGATCTGATCTCCCAAATGATTGAT CACGATCCGTTAAAAAGACCTACTGCTATGAAAGTTCTAAGGCAT CCGTTGTTTTGGCCAAAGTCGAAAAAATTGGAGTTCCTTTTAAAA GTTAGTGATAGGCTTGAAATTGAAAACAGAGACCCTCCAAGTGCC CTGTTAATGAAATTTGACGCCGGTTCTGACTTTGTAATACCCAGT GGAGATTGGACTGTCAAGTTTGATAAAACATTCATGGACAACCTT GAAAGGTACAGAAAATACCATTCATCAAAGTTAATGGATCTATTA AGAGCACTTAGGAATAAATATCATCATTTTATGGATTTACCTGAA GATATAGCAGAACTAATGGGGCCGGTACCCGATGGATTTTACGAT TACTTCACCAAGCGTTTTCCAAACCTATTAATAGGTGTTTATATG ATTGTCAAGGAAAATTTAAGTGACGATCAAATTTTACGTGAATTT TTGTATTCATAA |
| SEQ ID NO: 296<br>IRE1 fragment<br>Artificial Sequence | MLVLTLLVCVFSSIISCSIPLSSRTSRRQIVEDEVASTKKLNFNY GVDKNINSPIPAPRTTEGLPNMKLSSYPTPNLLNTADNRRANKKG RRAANSISVPYLENRSLNELSLSDILIAADVEGGLHAVDRRNGHI IWSIEPENFQPLIEIQEPSRLETYETLIIEPFGDGNIYYFNAHQG LQKLPLSIRQLVSTSPLHLKTNIWNDSGKIVEDEKVYTGSMRTIM YTINMLNGEIISAFGPGSKNGYFGSQSVDCSPEEKIKLQECENMI VIGKTIFELGIHSYDGASYNVTYSTWQQNVLDVPLALQNTFSKDG MCIAPFRDKSLLASDLDFRIARWVSPTFPGIIVGLFDVFNDLRTN ENILVPHPFNPGDHESISSNKVYLDQTSNLSWFALSSQNFPSLVE SAPISRYASSDRWRVSSIFEDETLFKNAIMGVHQIYNNEYDHLYE NYEKTNSLDTTHKYPPLMIDSSVDTTDLHQNNEMNSLKEYMSP EDLEAYRKKIHEQISRELDEKNQNSLLLKFGSLVYRIIETGVFLL LFLIFCAILQRFKILPPLYVLLSKIGFMPEKEIPIVESKSLNCPS SSENVTKPFDMKSGKQVVFEGAVNDGSLKSEKDNDDADEDDEKSL DLTTEKKKRKRGSRGGKKGRKSRIANIPNFEQSLKNLWSEKILGY GSSGTWFQGSFQGRPVAVKRMLIDFCDIALMEIKLLTESDDHPNV IRYYCSETTDRFLYIALELCNLNLQDLVESKNVSDENLKLQKEYN PISLLRQIASGVAHLHSLKIIHRDLKPQNILVSTSSRFTADQQTG AENLRILISDFGLCKKLDSGQSSFRTNLNNPSGTSGWRAPELLEE SNNLQCQVETEHSSSRHTWSSDSFYDPFTKRRLTRSIDIFSMGCV FYYILSKGKHPFGDKYSRESNIIRGIFSLDEMKCLHDRSLIAEAT DLISQMIDHDPLKRPTAMKVLRHPLFWPKSKKLEFLLKVSDRLEI ENRDPPSALLMKFDAGSDFVIPSGDWTVKFDKTFMDNLERYRKYH SSKLMDLLRALRNKYHHFMDLPEDIAELMGPVPDGFYDYFTKRFP NLLIGVYMIVKENLSDDQILREFLYS* |

TABLE 1-continued

| Amino acid and nucleotide sequences of the disclosure | |
|---|---|
| SEQ ID NO: 297<br>FAD1<br>*Saccharomyces* sp. | ATGCAGTTGAGCAAGGCTGCTGAGATGTGTTATGAGATAACAAAC<br>TCTTACTTACACATAGACCAGAAATCTCAGATAATAGCAAGTACA<br>CAAGAAGCGATACGGTTGACAAGAAAATACTTACTAAGTGAAATT<br>TTTGTACGTTGGAGTCCACTGAATGGGGAAATATCATTCTCGTAC<br>AACGGAGGAAAAGATTGCCAGGTATTACTACTGTTATATCTGAGT<br>TGCTTATGGGAATATTTCTTCATTAAGGCTCAAAATTCCCAATTC<br>GATTTCGAGTTTCAAAGCTTCCCCATGCAAAGACTTCCAACTGTT<br>TTCATTGATCAAGAAGAAACTTTCCCTACATTAGAGAATTTTGTA<br>CTGGAAACCTCAGAGCGATATTGCCTTTCCTTATACGAATCACAA<br>AGGCAATCTGGTGCATCGGTCAATATGGCAGACGCATTTAGAGAT<br>TTTATAAAGATATACCCTGAGACCGAAGCTATAGTGATAGGTATT<br>AGACACACAGACCCATTTGGTGAAGCATTAAAGCCTATTCAAAGA<br>ACAGATTCTAACTGGCCTGATTTTATGAGGTTGCAACCTCTCTTA<br>CACTGGGACTTAACCAATATATGGAGTTTCTTACTGTATTCTAAT<br>GAGCCAATTTGTGGACTATATGGTAAAGGTTTCACATCAATCGGC<br>GGAATTAACAACTCATTGCCTAACCCACACTTGAGAAAGGACTCC<br>AATAATCCAGCCTTGCATTTTGAATGGGAAATCATTCATGCATTT<br>GGCAAGGACGCAGAAGGCGAACGTAGTTCCGCTATAAACACGTCA<br>CCTATTTCCGTGGTGGATAAGGAAAGATTCAGCAAATACCATGAC<br>AATTACTATCCTGGCTGGTATTTGGTTGATGACACTTTAGAGAGA<br>GCAGGCAGGATCAAGAATTAA |
| SEQ ID NO: 298<br>FAD1<br>*Saccharomyces* sp. | MQLSKAAEMCYEITNSYLHIDQKSQIIASTQEAIRLTRKYLLSEI<br>FVRWSPLNGEISFSYNGGKDCQVLLLLYLSCLWEYFFIKAQNSQF<br>DFEFQSFPMQRLPTVFIDQEETFPTLENFVLETSERYCLSLYESQ<br>RQSGASVNMADAFRDFIKIYPETEAIVIGIRHTDPFGEALKPIQR<br>TDSNWPDFMRLQPLLHWDLTNIWSFLLYSNEPICGLYGKGFTSIG<br>GINNSLPNPHLRKDSNNPALHFEWEIIHAFGKDAEGERSSAINTS<br>PISVVDKERFSKYHDNYYPGWYLVDDTLERAGRIKN* |
| SEQ ID NO: 299<br>CBDA Synthase,<br>I445M variant<br>Artificial Sequence | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAACTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACatgTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |
| SEQ ID NO: 300<br>CBDA Synthase,<br>I445M variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKIKLDYVKKPIPESVFVQILEKLYEE<br>DIGAGMYALYPYGGIMDEISESAIPFPHRAGILYELWYMCSWEKQ<br>EDNEKHLNWIRNIYNFMTPYVSKNPRLAYLNYRDLDIGINDPKNP |

TABLE 1-continued

| Amino acid and nucleotide sequences of the disclosure | |
|---|---|
| | NNYTQARIWGEKYFGKNFDRLVKVKTLVDPNNFFRNEQSIPPLPR HRH* |
| SEQ ID NO: 301 CBDA Synthase, M412Q variant Artificial Sequence | ATGAAATGCTCCACTTTCTCTTTCTGGTTCGTTTGTAAGATTATC TTCTTCTTCTTTTCTTTCAACATCCAAACTTCCATTGCCAACCCT CGTGAGAACTTCTTGAAATGTTTTTCTCAATATATCCCAAATAAC GCTACTAACTTGAAGTTAGTCTATACTCAAAACAACCCATTATAT ATGTCTGTCTTAAACTCTACCATTCACAACTTACGTTTCACTTCT GATACTACTCCAAAACCTTTGGTCATCGTCACCCCATCCCACGTT TCTCACATCCAAGGTACCATCTTGTGTTCCAAAAAGGTTGGTTTA CAAATCCGTACTAGATCCGGTGGTCATGACTCCGAAGGTATGTCT TACATTTCCCAAGTCCCTTTCGTCATCGTCGACTTAAGAAATATG CGTTCCATCAAGATTGATGTCCATTCCCAAACTGCTTGGGTTGAA GCCGGTGCCACTTTAGGTGAAGTCTATTACTGGGTTAACGAGAAG AATGAGAACTTATCTTTGGCTGCCGGTTACTGTCCAACTGTTTGT GCTGGTGGTCATTTCGGTGGTGGTGGTTACGGTCCATTAATGCGT AACTACGGTTTGGCTGCCGATAACATCATTGATGCCCACTTAGTC AACGTTCATGGTAAGGTCTTGGACCGTAAGTCTATGGGTGAGGAT TTATTCTGGGCTTTGAGAGGTGGTGGTGCTGAATCTTTCGGTATT ATCGTCGCTTGGAAGATTAGATTAGTTGCTGTTCCAAAGTCTACT ATGTTCTCTGTTAAGAAGATCATGGAAATTCACGAGTTGGTTAAA TTAGTTAACAAATGGCAAAACATTGCCTACAAGTACGATAAAGAT TTGTTATTAATGACTCACTTTATCACTAGAAACATTACTGATAAC CAAGGTAAGAATAAGACTGCCATTCACACTTACTTCTCTTCTGTT TTCTTGGGTGGTGTTGATTCCTTGGTCGATTTGATGAACAAGTCT TTTCCAGAATTAGGTATTAAGAAGACCGATTGTCGTCAACTGATA ATTTTAATAAGGAGATTTTGTTAGATAGATCTGCTGGTCAAAATG GTGCCTTTAAAATCAAATTGGACTACGTTAAGAAGCCTATTCCAG AATCCGTCTTTGTTCAAATTTTGGAGAAGTTATACGAAGAAGATA TTGGTGCTGGTcaaTACGCCTTGTATCCATATGGTGGTATTATGG ATGAAATTTCTGAATCCGCCATCCCTTTCCCTCATCGTGCTGGTA TCTTATACGAGTTGTGGTACATCTGTTCTTGGGAAAAGCAAGAAG ATAATGAAAAGCATTTGAACTGGATCCGTAACATCTATAACTTCA TGACTCCATACGTTTCCAAAAACCCTAGATTGGCTTACTTAAATT ACAGAGACTTAGATATTGGTATTAACGACCCTAAGAACCCAAACA ATTACACTCAAGCTAGAATCTGGGGTGAAAAGTACTTCGGTAAGA ATTTCGACAGATTAGTTAAGGTCAAGACTTTAGTTGACCCAAATA ACTTCTTCAGAAACGAACAATCTATCCCACCATTGCCTAGACATA GACACTAG |
| SEQ ID NO: 302 CBDA Synthase, M412Q variant Artificial Sequence | MKCSTFSFWFVCKIIFFFFSFNIQTSIANPRENFLKCFSQYIPNN ATNLKLVYTQNNPLYMSVLNSTIHNLRFTSDTTPKPLVIVTPSHV SHIQGTILCSKKVGLQIRTRSGGHDSEGMSYISQVPFVIVDLRNM RSIKIDVHSQTAWVEAGATLGEVYYWVNEKNENLSLAAGYCPTVC AGGHFGGGGYGPLMRNYGLAADNIIDAHLVNVHGKVLDRKSMGED LFWALRGGGAESFGIIVAWKIRLVAVPKSTMFSVKKIMEIHELVK LVNKWQNIAYKYDKDLLLMTHFITRNITDNQGKNKTAIHTYFSSV FLGGVDSLVDLMNKSFPELGIKKTDCRQLSWIDTIIFYSGWNYDT DNFNKEILLDRSAGQNGAFKIKLDYVKKPIPESVFVQILEKLYEE DIGAGQYALYPYGGIMDEISESAIPFPHRAGILYELWYICSWEKQ EDNEKHLNVVIRNIYNFMTPYVSKNPRLAYLNYRDLDIGINDPKN PNNYTQARIWGEKYFGKNFDRLVKVKTLVDPNNFFRNEQSIPPLP RHRH* |
| SEQ ID NO: 303 CBDA Synthase, L415M variant Artificial Sequence | ATGAAATGCTCCACTTTCTCTTTCTGGTTCGTTTGTAAGATTATC TTCTTCTTCTTTTCTTTCAACATCCAAACTTCCATTGCCAACCCT CGTGAGAACTTCTTGAAATGTTTTTCTCAATATATCCCAAATAAC GCTACTAACTTGAAGTTAGTCTATACTCAAAACAACCCATTATAT ATGTCTGTCTTAAACTCTACCATTCACAACTTACGTTTCACTTCT GATACTACTCCAAAACCTTTGGTCATCGTCACCCCATCCCACGTT TCTCACATCCAAGGTACCATCTTGTGTTCCAAAAAGGTTGGTTTA CAAATCCGTACTAGATCCGGTGGTCATGACTCCGAAGGTATGTCT TACATTTCCCAAGTCCCTTTCGTCATCGTCGACTTAAGAAATATG CGTTCCATCAAGATTGATGTCCATTCCCAAACTGCTTGGGTTGAA GCCGGTGCCACTTTAGGTGAAGTCTATTACTGGGTTAACGAGAAG AATGAGAACTTATCTTTGGCTGCCGGTTACTGTCCAACTGTTTGT GCTGGTGGTCATTTCGGTGGTGGTGGTTACGGTCCATTAATGCGT AACTACGGTTTGGCTGCCGATAACATCATTGATGCCCACTTAGTC AACGTTCATGGTAAGGTCTTGGACCGTAAGTCTATGGGTGAGGAT TTATTCTGGGCTTTGAGAGGTGGTGGTGCTGAATCTTTCGGTATT ATCGTCGCTTGGAAGATTAGATTAGTTGCTGTTCCAAAGTCTACT ATGTTCTCTGTTAAGAAGATCATGGAAATTCACGAGTTGGTTAAA TTAGTTAACAAATGGCAAAACATTGCCTACAAGTACGATAAAGAT TTGTTATTAATGACTCACTTTATCACTAGAAACATTACTGATAAC CAAGGTAAGAATAAGACTGCCATTCACACTTACTTCTCTTCTGTT TTCTTGGGTGGTGTTGATTCCTTGGTCGATTTGATGAACAAGTCT TTTCCAGAATTAGGTATTAAGAAGACCGATTGTCGTCAATTATCT TGGATTGATACCATTATTTTTTACTCCGGTGTTGTCAACTACGAC |

TABLE 1-continued

| Amino acid and nucleotide sequences of the disclosure | |
|---|---|
| | ACTGATAATTTTAATAAGGAGATTTTGTTAGATAGATCTGCTGGT<br>CAAAATGGTGCCTTTAAAATCAAATTGGACTACGTTAAGAAGCCT<br>ATTCCAGAATCCGTCTTTGTTCAAATTTTGGAGAAGTTATACGAA<br>GAAGATATTGGTGCTGGTATGTACGCCatgTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 304<br>CBDA Synthase,<br>L415M variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYVVVNEKNENLSLAAGYCPTV<br>CAGGHFGGGGYGPLMRNYGLAADNIIDAHLVNVHGKVLDRKSMGE<br>DLFWALRGGGAESFGIIVAWKIRLVAVPKSTMFSVKKIMEIHELV<br>KLVNKWQNIAYKYDKDLLLMTHFITRNITDNQGKNKTAIHTYFSS<br>VFLGGVDSLVDLMNKSFPELGIKKTDCRQLSWIDTIIFYSGVVNY<br>DTDNFNKEILLDRSAGQNGAFKIKLDYVKKPIPESVFVQILEKLY<br>EEDIGAGMYAMYPYGGIMDEISESAIPFPHRAGILYELVVYICSV<br>VEKQEDNEKHLNWIRNIYNFMTPYVSKNPRLAYLNYRDLDIGIND<br>PKNPNNYTQARIWGEKYFGKNFDRLVKVKTLVDPNNFFRNEQSIP<br>PLPRHRH* |
| SEQ ID NO: 305<br>CBDA Synthase,<br>D115N variant<br>Artificial Sequence | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATaatTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAG<br>GATTTATTCTGGGCTTTGAGAGGTGGTGGTGCTGAATCTTTCGGT<br>ATTATCGTCGCTTGGAAGATTAGATTAGTTGCTGTTCCAAAGTCT<br>ACTATGTTCTCTGTTAAGAAGATCATGGAAATTCACGAGTTGGTT<br>AAATTAGTTAACAAATGGCAAAACATTGCCTACAAGTACGATAAA<br>GATTTGTTATTAATGACTCACTTTATCACTAGAAACATTACTGAT<br>AACCAAGGTAAGAATAAGACTGCCATTCACACTTACTTCTCTTCT<br>GTTTTCTTGGGTGGTGTTGATTCCTTGGTCGATTTGATGAACAAG<br>TCTTTTCCAGAATTAGGTATTAAGAAGACCGATTGTCGTCAATTG<br>ATAATTTTAATAAGGAGATTTTGTTAGATAGATCTGCTGGTCAAA<br>ATGGTGCCTTTAAAATCAAATTGGACTACGTTAAGAAGCCTATTC<br>CAGAATCCGTCTTTGTTCAAATTTTGGAGAAGTTATACGAAGAAG<br>ATATTGGTGCTGGTATGTACGCCTTGTATCCATATGGTGGTATTA<br>TGGATGAAATTTCTGAATCCGCCATCCCTTTCCCTCATCGTGCTG<br>GTATCTTATACGAGTTGTGGTACATCTGTTCTTGGGAAAAGCAAG<br>AAGATAATGAAAAGCATTTGAACTGGATCCGTAACATCTATAACT<br>TCATGACTCCATACGTTTCCAAAAACCCTAGATTGGCTTACTTAA<br>ATTACAGAGACTTAGATATTGGTATTAACGACCCTAAGAACCCAA<br>ACAATTACACTCAAGCTAGAATCTGGGGTGAAAAGTACTTCGGTA<br>AGAATTTCGACAGATTAGTTAAGGTCAAGACTTTAGTTGACCCAA<br>ATAACTTCTTCAGAAACGAACAATCTATCCCACCATTGCCTAGAC<br>ATAGACACTAG |
| SEQ ID NO: 306<br>CBDA Synthase,<br>D115N variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHNSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGVVNYD<br>TDNFNKEILLDRSAGQNGAFKIKLDYVKKPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>RHRH* |

TABLE 1-continued

| Amino acid and nucleotide sequences of the disclosure | |
|---|---|
| SEQ ID NO: 307<br>CBDA Synthase,<br>A4I4T variant<br>Artificial Sequence | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAACTGATA<br>ATTTTAATAAGGAGATTTTGTTAGATAGATCTGCTGGTCAAAATG<br>GTGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACACTTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |
| SEQ ID NO: 308<br>CBDA Synthase,<br>A414T variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGVVNYD<br>TDNFNKEILLDRSAGQNGAFKIKLDYVKKPIPESVFVQILEKLYE<br>EDIGAGMYTLYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>RHRH* |
| SEQ ID NO: 309<br>CBDA Synthase,<br>A414V variant<br>Artificial Sequence | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT<br>CAAAATGGTGCCTTTAAAATCAAATTGGACTACGTTAAGAAGCCT |

TABLE 1-continued

| Amino acid and nucleotide sequences of the disclosure | |
|---|---|
| | ATTCCAGAATCCGTCTTTGTTCAAATTTTGGAGAAGTTATACGAA GAAGATATTGGTGCTGGTATGTACGttTTGTATCCATATGGTGGT ATTATGGATGAAATTTCTGAATCCGCCATCCCTTTCCCTCATCGT GCTGGTATCTTATACGAGTTGTGGTACATCTGTTCTTGGGAAAAG CAAGAAGATAATGAAAAGCATTTGAACTGGATCCGTAACATCTAT AACTTCATGACTCCATACGTTTCCAAAAACCCTAGATTGGCTTAC TTAAATTACAGAGACTTAGATATTGGTATTAACGACCCTAAGAAC CCAAACAATTACACTCAAGCTAGAATCTGGGGTGAAAAGTACTTC GGTAAGAATTTCGACAGATTAGTTAAGGTCAAGACTTTAGTTGAC CCAAATAACTTCTTCAGAAACGAACAATCTATCCCACCATTGCCT AGACATAGACACTAG |
| SEQ ID NO: 310<br>CBDA Synthase,<br>A414V variant<br>Artificial Sequence | MKCSTFSFWFVCKIIFFFFSFNIQTSIANPRENFLKCFSQYIPNN ATNLKLVYTQNNPLYMSVLNSTIHNLRFTSDTTPKPLVIVTPSHV SHIQGTILCSKKVGLQIRTRSGGHDSEGMSYISQVPFVIVDLRNM RSIKIDVHSQTAWVEAGATLGEVYYWVNEKNENLSLAAGYCPTVC AGGHFGGGGYGPLMRNYGLAADNIIDAHLVNVHGKVLDRKSMGED LFWALRGGGAESFGIIVAWKIRLVAVPKSTMFSVKKIMEIHELVK LVNKWQNIAYKYDKDLLLMTHFITRNITDNQGKNKTAIHTYFSSV FLGGVDSLVDLMNKSFPELGIKKTDCRQLSWIDTIIFYSGWNYDT DNFNKEILLDRSAGQNGAFKKLDYVKKPIPESVFVQILEKLYEED IGAGMYVLYPYGGIMDEISESAIPFPHRAGILYELWYICSWEKQE DNEKHLNWIRNIYNFMTPYVSKNPRLAYLNYRDLDIGINDPKNPN NYTQARIWGEKYFGKNFDRLVKVKTLVDPNNFFRNEQSIPPLPRH RH* |
| SEQ ID NO: 311<br>CBDA Synthase,<br>A414M variant<br>Artificial Sequence | ATGAAATGCTCCACTTTCTCTTTCTGGTTCGTTTGTAAGATTATC TTCTTCTTCTTTTCTTTCAACATCCAAACTTCCATTGCCAACCCT CGTGAGAACTTCTTGAAATGTTTTTCTCAATATATCCCAAATAAC GCTACTAACTTGAAGTTAGTCTATACTCAAAACAACCCATTATAT ATGTCTGTCTTAAACTCTACCATTCACAACTTACGTTTCACTTCT GATACTACTCCAAAACCTTTGGTCATCGTCACCCCATCCCACGTT TCTCACATCCAAGGTACCATCTTGTGTTCCAAAAAGGTTGGTTTA CAAATCCGTACTAGATCCGGTGGTCATGACTCCGAAGGTATGTCT TACATTTCCCAAGTCCCTTTCGTCATCGTCGACTTAAGAAATATG CGTTCCATCAAGATTGATGTCCATTCCCAAACTGCTTGGGTTGAA GCCGGTGCCACTTTAGGTGAAGTCTATTACTGGGTTAACGAGAAG AATGAGAACTTATCTTTGGCTGCCGGTTACTGTCCAACTGTTTGT GCTGGTGGTCATTTCGGTGGTGGTGGTTACGGTCCATTAATGCGT AACTACGGTTTGGCTGCCGATAACATCATTGATGCCCACTTAGTC AACGTTCATGGTAAGGTCTTGGACCGTAAGTCTATGGGTGAGGAT TTATTCTGGGCTTTGAGAGGTGGTGGTGCTGAATCTTTCGGTATT ATCGTCGCTTGGAAGATTAGATTAGTTGCTGTTCCAAAGTCTACT ATGTTCTCTGTTAAGAAGATCATGGAAATTCACGAGTTGGTTAAA TTAGTTAACAAATGGCAAAACATTGCCTACAAGTACGATAAAGAT TTGTTATTAATGACTCACTTTATCACTAGAAACATTACTGATAAC CAAGGTAAGAATAAGACTGCCATTCACACTTACTTCTCTTCTGTT TTCTTGGGTGGTGTTGATTCCTTGGTCGATTTGATGAACAAGTCT TTTCCAGAATTAGGTATTAAGAAGACCGATTGTCGTCAACTGATA ATTTTAATAAGGAGATTTTGTTAGATAGATCTGCTGGTCAAAATG GTGCCTTTAAAATCAAATTGGACTACGTTAAGAAGCCTATTCCAG AATCCGTCTTTGTTCAAATTTTGGAGAAGTTATACGAAGAAGATA TTGGTGCTGGTATGTACAtgTTGTATCCATATGGTGGTATTATGG ATGAAATTTCTGAATCCGCCATCCCTTTCCCTCATCGTGCTGGTA TCTTATACGAGTTGTGGTACATCTGTTCTTGGGAAAAGCAAGAAG ATAATGAAAAGCATTTGAACTGGATCCGTAACATCTATAACTTCA TGACTCCATACGTTTCCAAAAACCCTAGATTGGCTTACTTAAATT ACAGAGACTTAGATATTGGTATTAACGACCCTAAGAACCCAAACA ATTACACTCAAGCTAGAATCTGGGGTGAAAAGTACTTCGGTAAGA ATTTCGACAGATTAGTTAAGGTCAAGACTTTAGTTGACCCAAATA ACTTCTTCAGAAACGAACAATCTATCCCACCATTGCCTAGACATA GACACTAG |
| SEQ ID NO: 312<br>CBDA Synthase,<br>A4I4M variant<br>Artificial Sequence | MKCSTFSFWFVCKIIFFFFSFNIQTSIANPRENFLKCFSQYIPNN ATNLKLVYTQNNPLYMSVLNSTIHNLRFTSDTTPKPLVIVTPSHV SHIQGTILCSKKVGLQIRTRSGGHDSEGMSYISQVPFVIVDLRNM RSIKIDVHSQTAWVEAGATLGEVYYWVNEKNENLSLAAGYCPTVC AGGHFGGGGYGPLMRNYGLAADNIIDAHLVNVHGKVLDRKSMGED LFWALRGGGAESFGIIVAWKIRLVAVPKSTMFSVKKIMEIHELVK LVNKWQNIAYKYDKDLLLMTHFITRNITDNQGKNKTAIHTYFSSV FLGGVDSLVDLMNKSFPELGIKKTDCRQLSWIDTIIFYSGVVNYD TDNFNKEILLDRSAGQNGAFKIKLDYVKKPIPESVFVQILEKLYE EDIGAGMYMLYPYGGIMDEISESAIPFPHRAGILYELWYICSWEK QEDNEKHLNWIRNIYNFMTPYVSKNPRLAYLNYRDLDIGINDPKN PNNYTQARIWGEKYFGKNFDRLVKVKTLVDPNNFFRNEQSIPPLP RHRH* |

TABLE 1-continued

| Amino acid and nucleotide sequences of the disclosure | |
|---|---|
| SEQ ID NO: 313<br>CBDA Synthase,<br>M61W, G378T variant<br>Artificial Sequence | ATGAAATGCTCCACTTTCTCTTTCTGGTrCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>tggTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTGATA<br>ATTTTAATAAGGAGATTTGTTAGATAGATCTGCTGGTCAAAATa<br>ctGCCTTTAAAATCAAATTGGACTACGTTAAGAAGCCTATTCCAG<br>AATCCGTCTTTGTTCAAATTTTGGAGAAGTTATACGAAGAAGATA<br>TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |
| SEQ ID NO: 314<br>CBDA Synthase,<br>M61W, G378T variant<br>Artificial Sequence | MKCSTFSFWFVCKIIFFFFSFNIQTSIANPRENFLKCFSQYIPNN<br>ATNLKLVYTQNNPLYWSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNTAFKIKLDYVKKPIPESVFVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP<br>NNYTQARIWGEKYFGKNFDRLVKVKTLVDPNNFFRNEQSIPPLPR<br>HRH* |
| SEQ ID NO: 315<br>CBDA Synthase,<br>M61W, K389E variant<br>Artificial Sequence | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>tggTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTGATA<br>ATTTTAATAAGGAGATTTGTTAGATAGATCTGCTGGTCAAAATG<br>GTGCCTTTAAAATCAAATTGGACTACGTTAAGgaaCCTATTCCAG<br>AATCCGTCTTTGTTCAAATTTTGGAGAAGTTATACGAAGAAGATA |

TABLE 1-continued

| Amino acid and nucleotide sequences of the disclosure | |
|---|---|
| | TTGGTGCTGGTATGTACGCCTTGTATCCATATGGTGGTATTATGG<br>ATGAAATTTCTGAATCCGCCATCCCTTTCCCTCATCGTGCTGGTA<br>TCTTATACGAGTTGTGGTACATCTGTTCTTGGGAAAAGCAAGAAG<br>ATAATGAAAAGCATTTGAACTGGATCCGTAACATCTATAACTTCA<br>TGACTCCATACGTTTCCAAAAACCCTAGATTGGCTTACTTAAATT<br>ACAGAGACTTAGATATTGGTATTAACGACCCTAAGAACCCAAACA<br>ATTACACTCAAGCTAGAATCTGGGGTGAAAAGTACTTCGGTAAGA<br>ATTTCGACAGATTAGTTAAGGTCAAGACTTTAGTTGACCCAAATA<br>ACTTCTTCAGAAACGAACAATCTATCCCACCATTGCCTAGACATA<br>GACACTAG |
| SEQ ID NO: 316<br>CBDA Synthase,<br>M61W, K389E variant<br>Artificial Sequence | MKCSTFSFWFVCKIIFFFFSFNIQTSIANPRENFLKCFSQYIPNN<br>ATNLKLVYTQNNPLYWSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIMEIHELVK<br>LVNKWQNIAYKYDKDLLLMTHFITRNITDNQGKNKTAIHTYFSSV<br>FLGGVDSLVDLMNKSFPELGIKKTDCRQLSWIDTIIFYSGWNYDT<br>DNFNKEILLDRSAGQNGAFKIKLDYVKEPIPESVFVQILEKLYEE<br>DIGAGMYALYPYGGIMDEISESAIPFPHRAGILYELWYICSWEKQ<br>EDNEKHLNWIRNIYNFMTPYVSKNPRLAYLNYRDLDIGINDPKNP<br>NNYTQARIWGEKYFGKNFDRLVKVKTLVDPNNFFRNEQSIPPLPR<br>HRH* |
| SEQ ID NO: 317<br>CBDA Synthase,<br>G378T, K389E variant<br>Artificial Sequence | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>ATGTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACATTTCCCAAGTCCCTTTCGTCATCGTCGACTTAAGAAATATG<br>CGTTCCATCAAGATTGATGTCCATTCCCAAACTGCTTGGGTTGAA<br>GCCGGTGCCACTTTAGGTGAAGTCTATTACTGGGTTAACGAGAAG<br>AATGAGAACTTATCTTTGGCTGCCGGTTACTGTCCAACTGTTTGT<br>GCTGGTGGTCATTTCGGTGGTGGTGGTTACGGTCCATTAATGCGT<br>AACTACGGTTTGGCTGCCGATAACATCATTGATGCCCACTTAGTC<br>AACGTTCATGGTAAGGTCTTGGACCGTAAGTCTATGGGTGAGGAT<br>TTATTCTGGGCTTTGAGAGGTGGTGGTGCTGAATCTTTCGGTATT<br>ATCGTCGCTTGGAAGATTAGATTAGTTGCTGTTCCAAAGTCTACT<br>ATGTTCTCTGTTAAGAAGATCATGGAAATTCACGAGTTGGTTAAA<br>TTAGTTAACAAATGGCAAAACATTGCCTACAAGTACGATAAAGAT<br>TTGTTATTAATGACTCACTTTATCACTAGAAACATTACTGATAAC<br>CAAGGTAAGAATAAGACTGCCATTCACACTTACTTCTCTTCTGTT<br>TTCTTGGGTGGTGTTGATTCCTTGGTCGATTTGATGAACAAGTCT<br>TTTCCAGAATTAGGTATTAAGAAGACCGATTGTCGTCAATTATCT<br>TGGATTGATACCATTATTTTTTACTCCGGTGTTGTCAACTACGAC<br>ACTGATAATTTTAATAAGGAGATTTTGTTAGATAGATCTGCTGGT<br>CAAAATactGCCTTTAAAATCAAATTGGACTACGTTAAGgaaCCT<br>ATTCCAGAATCCGTCTTTGTTCAAATTTTGGAGAAGTTATACGAA<br>GAAGATATTGGTGCTGGTATGTACGCCTTGTATCCATATGGTGGT<br>ATTATGGATGAAATTTCTGAATCCGCCATCCCTTTCCCTCATCGT<br>GCTGGTATCTTATACGAGTTGTGGTACATCTGTTCTTGGGAAAAG<br>CAAGAAGATAATGAAAAGCATTTGAACTGGATCCGTAACATCTAT<br>AACTTCATGACTCCATACGTTTCCAAAAACCCTAGATTGGCTTAC<br>TTAAATTACAGAGACTTAGATATTGGTATTAACGACCCTAAGAAC<br>CCAAACAATTACACTCAAGCTAGAATCTGGGGTGAAAAGTACTTC<br>GGTAAGAATTTCGACAGATTAGTTAAGGTCAAGACTTTAGTTGAC<br>CCAAATAACTTCTTCAGAAACGAACAATCTATCCCACCATTGCCT<br>AGACATAGACACTAG |
| SEQ ID NO: 318<br>CBDA Synthase,<br>G378T, K389E variant<br>Artificial Sequence | MKCSTFSFWFVCKIIFFFFSFNIQTSIANPRENFLKCFSQYIPNN<br>ATNLKLVYTQNNPLYMSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAVVVEAGATLGEVYYWVNEKNENLSLAAGYCPTV<br>CAGGHFGGGGYGPLMRNYGLAADNIIDAHLVNVFIGKVLDRKSMG<br>EDLFWALRGGGAESFGIIVAWKIRLVAVPKSTMFSVKKIVIEIHE<br>LVKLVNKVVQNIAYKYDKDLLLMTHFITRNITDNQGKNKTAIHTY<br>FSSVFLGGVDSLVDLMNKSFPELGIKKTDCRQLSWIDTIIFYSGV<br>VNYDTDNFNKEILLDRSAGQNTAFKIKLDYVKEPIPESVFVQILE<br>KLYEEDIGAGMYALYPYGGIMDEISESAIPFPHRAGILYELWYIC<br>SWEKQEDNEKHLNWIRNIYNFMTPYVSKNPRLAYLNYRDLDIGIN<br>DPKNPNNYTQARIWGEKYFGKNFDRLVKVKTLVDPNNFFRNEQSI<br>PPLPRHRH* |

TABLE 1-continued

| Amino acid and nucleotide sequences of the disclosure | |
|---|---|
| SEQ ID NO: 319<br>CBDA Synthase,<br>M61W, G378T, K389E<br>variant<br>Artificial Sequence | ATGAAATGCTCCACTTTCTCTTTCTGGTTCGTTTGTAAGATTATC<br>TTCTTCTTCTTTTCTTTCAACATCCAAACTTCCATTGCCAACCCT<br>CGTGAGAACTTCTTGAAATGTTTTTCTCAATATATCCCAAATAAC<br>GCTACTAACTTGAAGTTAGTCTATACTCAAAACAACCCATTATAT<br>tggTCTGTCTTAAACTCTACCATTCACAACTTACGTTTCACTTCT<br>GATACTACTCCAAAACCTTTGGTCATCGTCACCCCATCCCACGTT<br>TCTCACATCCAAGGTACCATCTTGTGTTCCAAAAAGGTTGGTTTA<br>CAAATCCGTACTAGATCCGGTGGTCATGACTCCGAAGGTATGTCT<br>TACAT<br>TTCCCAAGTCCCTTTCGTCATCGTCGACTTAAGAAATATGCGTTC<br>CATCAAGATTGATGTCCATTCCCAAACTGCTTGGGTTGAAGCCGG<br>TGCCACTTTAGGTGAAGTCTATTACTGGGTTAACGAGAAGAATGA<br>GAACTTATCTTTGGCTGCCGGTTACTGTCCAACTGTTTGTGCTGG<br>TGGTCATTTCGGTGGTGGTGGTTACGGTCCATTAATGCGTAACTA<br>CGGTTTGGCTGCCGATAACATCATTGATGCCCACTTAGTCAACGT<br>TCATGGTAAGGTCTTGGACCGTAAGTCTATGGGTGAGGATTTATT<br>CTGGGCTTTGAGAGGTGGTGGTGCTGAATCTTTCGGTATTATCGT<br>CGCTTGGAAGATTAGATTAGTTGCTGTTCCAAAGTCTACTATGTT<br>CTCTGTTAAGAAGATCATGGAAATTCACGAGTTGGTTAAATTAGT<br>TAACAAATGGCAAAACATTGCCTACAAGTACGATAAAGATTTGTT<br>ATTAATGACTCACTTTATCACTAGAAACATTACTGATAACCAAGG<br>TAAGAATAAGACTGCCATTCACACTTACTTCTCTTCTGTTTTCTT<br>GGGTGGTGTTGATTCCTTGGTCGATTTGATGAACAAGTCTTTTCC<br>AGAATTAGGTATTAAGAAGACCGATTGTCGTCAATTGATAATTTT<br>AATAAGGAGATTTTGTTAGATAGATCTGCTGGTCAAAATactGCC<br>TTTAAAATCAAATTGGACTACGTTAAGgaaCCTATTCCAGAATCC<br>GTCTTTGTTCAAATTTTGGAGAAGTTATACGAAGAAGATATTGGT<br>GCTGGTATGTACGCCTTGTATCCATATGGTGGTATTATGGATGAA<br>ATTTCTGAATCCGCCATCCCTTTCCCTCATCGTGCTGGTATCTTA<br>TACGAGTTGTGGTACATCTGTTCTTGGGAAAAGCAAGAAGATAAT<br>GAAAAGCATTTGAACTGGATCCGTAACATCTATAACTTCATGACT<br>CCATACGTTTCCAAAAACCCTAGATTGGCTTACTTAAATTACAGA<br>GACTTAGATATTGGTATTAACGACCCTAAGAACCCAAACAATTAC<br>ACTCAAGCTAGAATCTGGGGTGAAAAGTACTTCGGTAAGAATTTC<br>GACAGATTAGTTAAGGTCAAGACTTTAGTTGACCCAAATAACTTC<br>TTCAGAAACGAACAATCTATCCCACCATTGCCTAGACATAGACAC<br>TAG |
| SEQ ID NO: 320<br>CBDA Synthase,<br>M61W, G378T, K389E<br>variant<br>Artificial Sequence | MKCSTFSFWFVCKIIFFFFSFNIQTSIANPRENFLKCFSQYIPNN<br>ATNLKLVYTQNNPLYWSVLNSTIHNLRFTSDTTPKPLVIVTPSHV<br>SHIQGTILCSKKVGLQIRTRSGGHDSEGMSYISQVPFVIVDLRNM<br>RSIKIDVHSQTAWVEAGATLGEVYYWVNEKNENLSLAAGYCPTVC<br>AGGHFGGGGYGPLMRNYGLAADNIIDAHLVNVHGKVLDRKSMGED<br>LFWALRGGGAESFGIIVAWKIRLVAVPKSTMFSVKKIYIEIHELV<br>KLVNKWQNIAYKYDKDLLLMTHFITRNITDNQGKNKTAIHTYFSS<br>VFLGGVDSLVDLMNKSFPELGIKKTDCRQLSWIDTIIFYSGWNYD<br>TDNFNKEILLDRSAGQNTAFKIKLDYVKEPIPESVFVQILEKLYE<br>EDIGAGMYALYPYGGIMDEISESAIPFPHRAGILYELWYICSWEK<br>QEDNEKHLNWIRNIYNFMTPYVSKNPRLAYLNYRDLDIGINDPKN<br>PNNYTQARIWGEKYFGKNFDRLVKVKTLVDPNNFFRNEQSIPPLP<br>RHRH* |
| SEQ ID NO: 323<br>i33 native sequence<br>*Saccharomyces* sp. | GTTAACCATTCTGGTTCACTTGCCGTCGTATGTTGCGGACCACCT<br>ATTTTCGTCGACACCGCTAGAAATCAAACTGCCAAAGCTGTTATC<br>AGAAACCCATCAAGAATGATTGAATACTTGGAGGAATACCAAGCC<br>TGGTGAACAATTTTTCATATTTAAGTAAACACTCAATGTATAATA<br>TCCTCTAACTGTTGTAATTTCATTAACGTAAATGGTTTGCGCCTT<br>TTTTAGGGGACCCTTGTTGATTCATTCTAACTACTGAGGCATAAG<br>TTGTTTCAAATAACACTTTTTCAGAAAAATAATCGTATTAAAAAG<br>CAGAAAAATCATACGTAAGATGACAGAAGCTTCATATTTAGTAAC<br>TCTGAATTGTATAACACACCAATTGCCGATAGAATATGAACCAAT<br>CGATCTTCAGCGTTCATGTACTTAATTTAACTACCTGTATTTTCT<br>TATAAAGATAAAATTGGTGTATAATGTAAGGGCCAAGAGAAAAAG<br>GAATCCCGCATCCCAAGCAACTTCTAGTGGACTATTTCTTCAAAA<br>AAATAACTGAATAAACACCTATATAATGTTCAGAGGTTATACTTT<br>AGTGTTTTAGAATGCAGTACCAAAAGTAATATATTGAATTAATAA<br>CTATATGATGTGTAGCTAAGAATTAAATAGTAAACGTCTTCTGAA<br>ACCTTTTAAGAGGTAATTATTGGTATTCCAAAGTCATATGTGGAG<br>GTAAGGGAGACACAAAATTATCTGGAATGACAGCGTGCTGACACA<br>TATAAAGTTCCGTAACTTCAAATGCCTTCATTATTCAACATAGGA<br>AAAGTGAAATGTGTGCCTCTAAAATATACGGAACATCGTCGAACT<br>AAAAAAATCCATTAAGCAAAGTTAGAAACAGCATGCACTACAAGA<br>CATTTGGTTCATCATGAAGAATGCTCAATTGAACCATCAATCACT<br>TTCTCTTGTTCGATGTTAGCATTATCCTCACTATCAGTTGAATCC<br>TCAATGCTTTCGGTTTCAGTCCTCGCATCTTCCTGAACTT |

EXAMPLES

The following examples are put forth so as to provide those of ordinary skill in the art with a complete disclosure and description of how to make and use the present disclosure, and are not intended to limit the scope of what the inventors regard as their disclosure nor are they intended to represent that the experiments below are all or the only experiments performed. Efforts have been made to ensure accuracy with respect to numbers used (e.g., amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); s or sec, second(s); min, minute(s); h or hr, hour(s); aa, amino acid(s); bp, base pair(s); nt, nucleotide(s); and the like.

Example 1: CBDAS Library Design, Construction, and Transformations

A saturation mutagenesis library of the CBDAS enzyme was synthesized by Twist Biosciences. The library was based on the full-length DNA sequence of CBDASco5 (SEQ ID NO:2), which encodes a wild type CBDAS sequence. Each construct was synthesized with 75 bp homology to the 3' end of the GAL1 promoter at the 5' end of the construct, and 75 bp homology to the tTDH1 terminator at the 3' end of the construct. The library was arrayed in 96 well plate format, where each well contained a mixture of constructs encoding all possible amino acid variants for a single position, excluding the native amino acid and stop codons. All amino acid positions were varied in this way with the exception of the initiating methionine and stop codon. Amino acid variants were encoded by high frequency codons (Table 1).

Example 2: Competition Assay Strains

To evaluate variant CBDAS constructs in the context of competition with a second cannabinoid synthase, strain S478 was used. Strain S478, described in Table 5 contains all engineering required for production of CBGA from fed olivetolic acid (OA) as well as chaperones and secretory pathway engineering features that support expression of CBDAS. Additionally, Strain S478 contains an integrated THCAS construct under control of the pGAL10 promoter. Library constructs were integrated at a second locus using yeast transformation methods described herein. Single colonies were inoculated directly into the 96 well plate assay. Upon completion, samples were extracted and assayed by LC-MS. Competition assay data are shown in Table 2.

Once hits were identified in the initial n=1 screening, they were re-struck from the pre-culture well onto agar, and the variant synthase was PCR amplified and Sanger sequenced to identify the causal mutation. In multiple cases, especially for the most improved enzymes, it was observed that the same mutation was recovered multiple times, with remarkably similar competition ratios. This result increases our confidence in the reliability of the screening system and the efficacy of the identified mutations.

In total, 6,528 colonies were screened in the initial n=1 round. Of these colonies, 4,410 showed >50% reduction in CBDA titer. This is a relatively high level of loss of function. Prior studies on three different proteins have shown severe loss of function (>90% reduction in activity) for approximately 33% of mutations. (Crit Rev Biochem Mol Biol. 2007 September-October; 42(5): 10.1080/10409230701597642.). Applying the same metric to the initial CBDAS screening data shows that 45.6% of all clones tested had this severe loss of function. This surprising result is an indication of how difficult engineering this secreted plant enzyme is. The *Cannabis* trichome is a considerably different than the yeast cell, and it is reasonable to speculate that these differences could destabilizes the enzyme, leading to greater sensitivity to mutations. This further highlights the importance of identifying context-dependent gain of function mutations that adapt the CBDAS to the yeast environment.

TABLE 2

Competition Assay Data

| Strain | Mutation | Ratio (mM) | Std Dev | CBDA (mg/L) | Std Dev | THCA (mg/L) | Std Dev | OD600 | Std Dev |
|---|---|---|---|---|---|---|---|---|---|
| S562 | NA | 3.13 | 0.18 | 164.91 | 8.47 | 52.85 | 4.52 | 2.81 | 0.26 |
| S606 | C12F | 3.95 | 0.25 | 123.66 | 27.68 | 31.35 | 7.16 | 2.35 | 0.58 |
| S607 | F17M | 3.81 | 0.26 | 154.01 | 9.35 | 40.59 | 3.17 | 2.36 | 0.29 |
| S608 | F18T | 3.83 | 0.38 | 88.12 | 49.56 | 22.35 | 11.91 | 2.06 | 0.86 |
| S609 | F18W | 3.59 | 0.57 | 122.11 | 20.8 | 34.39 | 5.63 | 2.44 | 0.42 |
| S610 | S20G | 3.98 | 0.51 | 117.85 | 46.79 | 30.13 | 12.91 | 1.98 | 0.76 |
| S611 | R31Q | 4.05 | 0.16 | 175.35 | 1.42 | 43.31 | 1.94 | 2.82 | 0.1 |
| S612 | N33K | 4.05 | 0.67 | 81.73 | 32.22 | 19.6 | 6.35 | 1.65 | 0.49 |
| S613 | P43E | 3.8 | 0.08 | 166.75 | 8.65 | 43.95 | 3.21 | 2.66 | 0.03 |
| S614 | L49E | 4.33 | 0.46 | 216.3 | 7.07 | 50.33 | 6.26 | 2.78 | 0.04 |
| S615 | L49K | 3.39 | 0.16 | 179.21 | 11.72 | 53 | 4 | 2.82 | 0.07 |
| S616 | L49Q | 3.77 | 0.25 | 188.45 | 10.28 | 50 | 0.87 | 2.86 | 0.08 |
| S617 | K50T | 4.2 | 0.07 | 197.76 | 5.93 | 47.11 | 1.22 | 2.56 | 0.04 |
| S618 | L51I | 4.27 | 0.51 | 125.52 | 65.82 | 31.01 | 17.98 | 2.16 | 0.82 |
| S619 | Q55E | 3.88 | 0.31 | 162.17 | 20.67 | 42.01 | 5.93 | 2.53 | 0.18 |
| S620 | Q55P | 4.03 | 0.36 | 148.46 | 26.02 | 37.41 | 10.03 | 2.49 | 0.59 |
| S621 | N56E | 3.9 | 0.23 | 172.67 | 21.29 | 44.45 | 6.67 | 2.64 | 0.09 |
| S622 | N57D | 4.24 | 0.31 | 180.09 | 3.62 | 42.71 | 3.98 | 2.59 | 0.15 |
| S623 | N57E | 4.14 | 0.37 | 159.48 | 5.42 | 38.77 | 4.5 | 2.51 | 0.2 |
| S624 | L59E | 5.18 | 0.62 | 96.47 | 15.62 | 18.87 | 3.67 | 1.57 | 0.28 |
| S625 | M61H | 3.89 | 0.64 | 144.99 | 47.06 | 39.09 | 16.77 | 2.19 | 0.49 |
| S626 | M61S | 4.85 | 0.23 | 96.22 | 6.15 | 19.89 | 1.89 | 1.5 | 0.38 |
| S627 | M61W | 4.86 | 0.2 | 60.69 | 10.62 | 12.44 | 1.72 | 1.25 | 0.04 |
| S628 | S62N | 4.61 | 0.15 | 143.94 | 7.53 | 31.19 | 1.15 | 3.05 | 0.05 |

TABLE 2-continued

| Competition Assay Data | | | | | | | | | |
|---|---|---|---|---|---|---|---|---|---|
| Strain | Mutation | Ratio (mM) | Std Dev | CBDA (mg/L) | Std Dev | THCA (mg/L) | Std Dev | OD600 | Std Dev |
| S629 | S62Q | 3.77 | 0.11 | 147.26 | 11.3 | 39.16 | 4.02 | 2.55 | 0.12 |
| S630 | V63M | 4.79 | 0.75 | 111.97 | 19.07 | 23.77 | 5.52 | 2.19 | 0.26 |
| S631 | S66D | 4.65 | 0.42 | 131.84 | 34.54 | 28.4 | 7.35 | 2.61 | 0.53 |
| S632 | L71A | 3.68 | 0.13 | 177.82 | 5.26 | 48.38 | 3.05 | 2.52 | 0.09 |
| S633 | L71H | 3.81 | 0.19 | 169.03 | 10.23 | 44.35 | 1.37 | 2.41 | 0.04 |
| S634 | L71Q | 4.08 | 0.27 | 179.78 | 9.3 | 44.28 | 4.89 | 2.58 | 0.14 |
| S635 | S75D | 3.53 | 0.11 | 158.12 | 8.7 | 44.82 | 3.8 | 2.53 | 0.05 |
| S636 | S75E | 3.51 | 0.17 | 154.17 | 3.08 | 43.96 | 1.53 | 2.47 | 0.05 |
| S637 | I97V | 3.94 | 0.32 | 161.05 | 2.53 | 41.04 | 3.84 | 2.67 | 0.1 |
| S638 | L98V | 3.59 | 0.02 | 121.38 | 3.5 | 33.83 | 0.87 | 2.85 | 0.28 |
| S639 | S100A | 4.29 | 0.21 | 200.9 | 3.32 | 46.93 | 2.32 | 2.57 | 0.04 |
| S640 | V103A | 3.51 | 0.51 | 177.1 | 2.63 | 51.03 | 6.43 | 2.76 | 0.17 |
| S641 | V103F | 3.35 | 0.07 | 180.18 | 9.52 | 53.81 | 2.31 | 2.67 | 0.04 |
| S642 | T109V | 3.28 | 0.2 | 178.61 | 7.75 | 54.61 | 3.02 | 2.79 | 0.01 |
| S643 | Q124D | 3.57 | 0.24 | 178.35 | 8.96 | 50 | 1.51 | 2.98 | 0.37 |
| S644 | Q124E | 3.79 | 0.3 | 161.39 | 12.17 | 42.96 | 6.39 | 3.02 | 0.59 |
| S645 | Q124N | 3.44 | 0.19 | 161.61 | 6.09 | 47 | 1.08 | 2.58 | 0.05 |
| S646 | V125E | 4.6 | 0.32 | 197.61 | 11.61 | 42.97 | 1.17 | 2.71 | 0.03 |
| S647 | V125Q | 3.49 | 0.09 | 171.93 | 2.88 | 49.25 | 1.51 | 2.68 | 0.13 |
| S648 | I129V | 3.43 | 0.31 | 174.38 | 0.93 | 51.2 | 5.07 | 2.68 | 0.06 |
| S649 | L132M | 3.79 | 0.61 | 182.82 | 18.8 | 48.63 | 3.68 | 2.39 | 0.25 |
| S650 | S137G | 3.56 | 0.2 | 179.33 | 3.79 | 50.54 | 3.85 | 2.59 | 0.08 |
| S651 | H143D | 4.25 | 0.07 | 185.71 | 3.37 | 43.75 | 1.3 | 2.62 | 0.05 |
| S652 | V149I | 4.38 | 0.31 | 125.14 | 8.33 | 28.76 | 3.87 | 3.75 | 0.05 |
| S653 | W161K | 3.26 | 0.15 | 183.12 | 3.69 | 56.22 | 2.82 | 2.61 | 0.05 |
| S654 | W161R | 3.8 | 0.06 | 189.13 | 9.34 | 49.73 | 2.99 | 2.61 | 0.06 |
| S655 | W161Y | 3.63 | 0.19 | 166.6 | 6.3 | 45.89 | 0.67 | 2.77 | 0.13 |
| S656 | K165A | 4.08 | 0.46 | 201.72 | 5.73 | 49.91 | 6.44 | 2.61 | 0.1 |
| S657 | E167P | 3.85 | 0.26 | 183.28 | 6.04 | 47.75 | 2.7 | 2.67 | 0.08 |
| S658 | N168S | 3.89 | 0.1 | 186.1 | 1.43 | 47.87 | 1.03 | 2.77 | 0.02 |
| S659 | S170T | 5.68 | 0.15 | 213.9 | 9.5 | 37.69 | 2.03 | 2.67 | 0.02 |
| S660 | L171I | 5.58 | 0.43 | 212.17 | 7.02 | 38.23 | 4.14 | 2.6 | 0.07 |
| S661 | A172V | 4.29 | 0.24 | 201.53 | 6.58 | 47.03 | 1.4 | 2.56 | 0.04 |
| S662 | Y175F | 4.4 | 0.81 | 180.68 | 4.74 | 42.42 | 8.58 | 2.74 | 0.14 |
| S663 | C180A | 3.59 | 0.15 | 172.49 | 11.13 | 47.99 | 2.51 | 2.63 | 0.06 |
| S664 | A181V | 4.25 | 0.19 | 187.76 | 6.23 | 44.32 | 3.27 | 2.58 | 0.07 |
| S665 | N196Q | 4.73 | 0.27 | 216.45 | 5.22 | 45.85 | 3.21 | 2.78 | 0.07 |
| S666 | N196T | 4.52 | 0.29 | 209.85 | 4.71 | 46.56 | 3.19 | 2.8 | 0.06 |
| S667 | N196V | 4.57 | 0.15 | 206.15 | 4.38 | 45.12 | 1.6 | 2.89 | 0.13 |
| S668 | H208T | 3.26 | 0.37 | 185.74 | 16.77 | 57.09 | 1.94 | 2.76 | 0.01 |
| S669 | A235P | 4.33 | 0.19 | 210.94 | 1.07 | 48.74 | 1.94 | 2.78 | 0.05 |
| S670 | A250T | 3.4 | 0.31 | 181.44 | 4.49 | 53.64 | 5.72 | 2.79 | 0.07 |
| S671 | M256V | 3.57 | 0.13 | 176.82 | 3.15 | 49.63 | 2.03 | 2.64 | 0.04 |
| S672 | K260C | 4.77 | 0.6 | 198.67 | 3.92 | 42.04 | 4.81 | 2.97 | 0.13 |
| S673 | K260W | 4.42 | 0.23 | 202.46 | 3.69 | 45.87 | 2.94 | 2.71 | 0.08 |
| S674 | L268I | 3.94 | 0.09 | 213.24 | 4.37 | 54.07 | 0.08 | 2.73 | 0.03 |
| S675 | H309V | 4.67 | 0.53 | 196.22 | 2.3 | 42.4 | 4.87 | 2.67 | 0.08 |
| S676 | T310A | 4.91 | 0.18 | 207.61 | 3.77 | 42.27 | 1 | 2.64 | 0.09 |
| S677 | T310C | 3.76 | 0.04 | 192.94 | 1.11 | 51.25 | 0.41 | 2.59 | 0.03 |
| S678 | F316Y | 4.9 | 0.49 | 204.15 | 2.98 | 41.95 | 4.01 | 2.72 | 0.04 |
| S679 | L326I | 4.29 | 0.51 | 190.04 | 7.99 | 44.71 | 5.43 | 2.6 | 0.05 |
| S680 | G378T | 4.59 | 0.43 | 181.97 | 2.09 | 39.81 | 3.25 | 2.59 | 0.01 |
| S681 | G378S | 3.94 | 0.26 | 173.32 | 1.44 | 44.09 | 3.26 | 2.69 | 0.11 |
| S682 | K389E | 4.1 | 0.14 | 189.16 | 3.07 | 46.17 | 1.94 | 2.74 | 0.02 |
| S683 | E406K | 4.48 | 0.16 | 199.44 | 5.43 | 44.55 | 1.43 | 2.61 | 0.07 |
| S684 | S428L | 4.44 | 0.28 | 196.94 | 6.43 | 44.39 | 1.53 | 2.61 | 0.11 |
| S685 | L439M | 3.42 | 0.28 | 174.39 | 2.26 | 51.16 | 3.57 | 2.62 | 0.01 |
| S686 | N466D | 3.74 | 0.2 | 184.79 | 3.73 | 49.53 | 1.75 | 2.57 | 0.11 |
| S687 | K474S | 3.92 | 0.09 | 180.41 | 6.8 | 46.02 | 2.84 | 2.48 | 0.1 |
| S688 | Y499M | 4.32 | 0.65 | 183.01 | 19.13 | 42.59 | 3.04 | 2.58 | 0.11 |
| S689 | Y499V | 4.3 | 0.11 | 202.74 | 5.51 | 47.11 | 0.97 | 2.61 | 0.09 |
| S690 | N527E | 4.54 | 0.04 | 221.17 | 7.69 | 48.72 | 1.46 | 2.7 | 0.04 |
| S691 | P538T | 2.22 | 0.09 | 107.31 | 9.75 | 48.18 | 2.44 | 2.12 | 0.05 |
| S692 | R541E | 4.05 | 0.49 | 156.8 | 57.75 | 37.88 | 10.63 | 2.57 | 0.16 |
| S693 | R541V | 3.5 | 0.08 | 180.51 | 13.23 | 51.54 | 2.7 | 2.5 | 0.12 |
| S694 | H542V | 3.33 | 0.15 | 173.59 | 5.52 | 52.25 | 3.51 | 2.63 | 0.11 |
| S695 | R543A | 3.8 | 0.16 | 172.37 | 1.49 | 45.46 | 1.8 | 2.68 | 0.15 |
| S696 | R543E | 3.49 | 0.05 | 173.7 | 6.64 | 49.86 | 2.54 | 2.63 | 0.25 |
| S697 | H544E | 4.93 | 0.24 | 213.7 | 6.01 | 43.43 | 3.14 | 2.51 | 0.06 |
| S698 | H544D | 5.24 | 0.19 | 204.23 | 9.94 | 39.07 | 3.31 | 2.71 | 0.18 |

Example 3: Non-Competition Assay Strains

Selected constructs were further evaluated in a non-competition strain background, strain S487. Strain S487, described in Table 5, contains all engineering required for production of CBGA from fed olivetolic acid as well as chaperones and secretory pathway engineering features that support expression of CBDAS. Variant CBDAS constructs were PCR amplified from the selected competition strains and were integrated into S487 using yeast transformation methods described herein. A subset of these constructs were also tested in a strain, S510. Strain S510, described in Table 5, contains all engineering required for production of CBGA from fed olivetolic acid as well as a much more limited set of chaperones and secretory pathway engineering features that support expression of CBDAS. Single colonies from the transformations were inoculated directly into the 96 well plate assay. Upon completion, samples were extracted and assayed by LC-MS. The data for this assay are shown in Tables 3 and 4.

In total, 6,528 variants were screened in the competition background and possible hits were replicated to confirm. All validated hits were then tested in the non-competition assay to assess actual performance.

Considering strains S699-S791, CBDA titers were improved (outside standard deviation of wild type, S579) in 68 distinct variants covering 53 positions (nearly 10% of all residues). Preliminary mapping to a structural model shows that many mutations increase the hydrophilicity of solvent-exposed residues, which may improve solubility of the enzyme in an aqueous (non-trichome) environment. Additionally, some variants displayed a reduction in undesired THCA production. Moreover, growth, as measured by optical density (OD) was improved in most variants. Expression of wild type CBDAS makes strains sick, so this is a desirable outcome. A subset of the constructs that improved titers in the S487 background were also tested in S510 background, which contains a more limited set of chaperone and secretory pathway engineering features. Of the 20 mutations tested in this strain, 14 improved titer over the wild type strain S1100, and six reduced titer. This result indicates that some but not all mutations identified in the S487 background require the support of more extensive chaperone and secretory pathway engineering to function.

TABLE 3

| Non-competition Assay | | | | | | | | | |
|---|---|---|---|---|---|---|---|---|---|
| Strain | Mutation | % THCA | Std Dev | CBDA (mg/L) | Std Dev | THCA (mg/L) | Std Dev | OD | Std Dev |
| S579 | NA | 7.61 | 0.91 | 162.07 | 15.36 | 14.4 | 2.32 | 2.46 | 0.15 |
| S699 | C12F | 8.66 | 0.81 | 132.3 | 0.86 | 12.55 | 1.32 | 3.05 | 0.4 |
| S700 | F17M | 7.91 | 1.17 | 160.01 | 13.13 | 13.74 | 2.36 | 2.67 | 0.14 |
| S701 | F18T | 7.4 | 0.69 | 133 | 11.5 | 10.62 | 1.32 | 2.61 | 0.14 |
| S702 | F18W | 7.77 | 1.08 | 145.29 | 11.91 | 12.17 | 1.25 | 2.43 | 0.07 |
| S703 | S20G | 8.04 | 1.44 | 149.93 | 7.59 | 13.19 | 2.94 | 2.74 | 0.11 |
| S704 | R31Q | 6.78 | 0.71 | 186.48 | 9.37 | 13.59 | 1.97 | 2.64 | 0.02 |
| S705 | N33K | 8.32 | 1 | 153.12 | 9.77 | 13.89 | 1.88 | 2.37 | 0.14 |
| S706 | P43E | 7.78 | 0.96 | 198.3 | 6.67 | 16.75 | 2.25 | 2.71 | 0.23 |
| S707 | L49E | 8.09 | 0.52 | 221.28 | 16.87 | 19.43 | 0.93 | 3.16 | 0.04 |
| S708 | L49K | 7.69 | 0.27 | 192.56 | 10.04 | 16.02 | 0.61 | 2.54 | 0.1 |
| S709 | L49Q | 7.86 | 0.44 | 206.98 | 13 | 17.71 | 2.1 | 2.69 | 0.12 |
| S710 | K50T | 8.17 | 0.52 | 205.99 | 2.22 | 18.34 | 1.32 | 2.66 | 0.08 |
| S711 | L51I | 8.15 | 0.7 | 188 | 12.35 | 16.72 | 2.26 | 2.49 | 0.32 |
| S712 | Q55E | 7.18 | 0.69 | 186.5 | 1.54 | 14.43 | 1.49 | 2.49 | 0.15 |
| S713 | Q55P | 7.3 | 0.63 | 182.74 | 2.85 | 14.39 | 1.4 | 2.61 | 0.17 |
| S714 | N56E | 8 | 0.32 | 215.47 | 6.61 | 18.73 | 0.92 | 2.84 | 0.05 |
| S715 | N57D | 7.05 | 0.96 | 223.94 | 7.72 | 17.06 | 3.03 | 2.73 | 0.05 |
| S716 | N57E | 7.71 | 0.42 | 142.47 | 12 | 11.86 | 0.43 | 2.77 | 0.16 |
| S717 | L59E | 7.61 | 0.39 | 160.45 | 6.03 | 13.22 | 0.88 | 2.31 | 0.08 |
| S718 | M61H | 7.18 | 0.64 | 176.09 | 4.86 | 13.64 | 1.47 | 3.33 | 0.11 |
| S719 | M61S | 7.88 | 0.79 | 175.52 | 4.41 | 15.33 | 1.22 | 2.95 | 0.22 |
| S720 | M61W | 6.83 | 0.61 | 180.49 | 10.73 | 13.29 | 1.97 | 3.15 | 0.32 |
| S721 | S62N | 7.91 | 1.13 | 142.05 | 6.05 | 12.2 | 1.83 | 2.75 | 0.02 |
| S722 | S62Q | 7.29 | 0.79 | 188.83 | 4.51 | 14.88 | 1.97 | 2.77 | 0.13 |
| S723 | V63M | 7.23 | 0.41 | 123.49 | 2.24 | 9.63 | 0.76 | 2.18 | 0.24 |
| S724 | S66D | 8.12 | 0.61 | 158.68 | 6.5 | 14.03 | 1.46 | 2.68 | 0.11 |
| S725 | L71A | 7.27 | 1.01 | 179.55 | 5.46 | 14.14 | 2.5 | 2.6 | 0.08 |
| S726 | L71H | 6.71 | 0.87 | 163.52 | 5.76 | 11.75 | 1.33 | 2.74 | 0.03 |
| S727 | L71Q | 7.68 | 0.62 | 172.74 | 7.9 | 14.42 | 1.88 | 2.74 | 0.06 |
| S728 | S75D | 7.3 | 1.11 | 155.85 | 3.07 | 12.26 | 1.8 | 2.71 | 0.05 |
| S729 | S75E | 8.57 | 0.59 | 155.44 | 8.67 | 14.57 | 1.26 | 2.72 | 0.07 |
| S730 | I97V | 8.28 | 1.11 | 172.47 | 10.43 | 15.65 | 2.99 | 2.68 | 0.02 |
| S731 | L98V | 8.08 | 0.84 | 124.45 | 9.88 | 10.95 | 1.51 | 2.7 | 0.07 |
| S732 | S100A | 7.81 | 1.76 | 194.51 | 4.7 | 16.53 | 4.08 | 2.63 | 0.07 |
| S733 | V103A | 7.53 | 0.67 | 171.55 | 14.95 | 14.04 | 2.4 | 2.8 | 0.1 |
| S734 | V103F | 8.41 | 0.73 | 197.08 | 2.83 | 18.12 | 1.81 | 2.92 | 0.03 |
| S735 | T109V | 7.91 | 0.43 | 198.91 | 0.81 | 17.08 | 0.94 | 2.95 | 0.03 |
| S736 | Q124D | 8.68 | 0.85 | 192.12 | 5.09 | 18.28 | 2.04 | 2.94 | 0.02 |
| S737 | Q124E | 8.6 | 0.57 | 175.75 | 2.64 | 16.54 | 1.32 | 2.84 | 0.08 |
| S738 | Q124N | 8.1 | 1.51 | 184.3 | 2.21 | 16.29 | 3.31 | 2.76 | 0.03 |
| S739 | V125E | 8.11 | 0.65 | 214.24 | 4.01 | 18.9 | 1.62 | 2.83 | 0.04 |
| S740 | V125Q | 8.4 | 0.21 | 184.39 | 8.73 | 16.92 | 1.11 | 2.91 | 0.02 |
| S741 | I129V | 8.35 | 1.06 | 183.7 | 7.44 | 16.83 | 2.97 | 2.71 | 0.1 |
| S742 | L132M | 7.4 | 1.15 | 229.74 | 10.56 | 18.31 | 2.54 | 3.14 | 0.12 |

TABLE 3-continued

| Non-competition Assay | | | | | | | | | | |
|---|---|---|---|---|---|---|---|---|---|---|
| Strain | Mutation | % THCA | Std Dev | CBDA (mg/L) | Std Dev | THCA (mg/L) | Std Dev | OD | Std Dev |
| S743 | S137G | 7.34 | 0.58 | 185.65 | 6.36 | 14.74 | 1.64 | 2.88 | 0.04 |
| S744 | H143D | 7.95 | 0.59 | 187.93 | 6.86 | 16.24 | 1.66 | 2.87 | 0.09 |
| S745 | V149I | 7.6 | 1.01 | 212.1 | 3.7 | 17.47 | 2.51 | 3.1 | 0.08 |
| S746 | W161K | 8.28 | 0.78 | 190.83 | 2.93 | 17.23 | 1.54 | 2.88 | 0.18 |
| S747 | W161R | 7.16 | 0.73 | 211.08 | 6.64 | 16.28 | 1.89 | 2.89 | 0.06 |
| S748 | W161Y | 7.3 | 0.82 | 194.18 | 5.19 | 15.27 | 1.54 | 2.78 | 0.06 |
| S749 | K165A | 7.43 | 0.53 | 221.03 | 3.43 | 17.77 | 1.62 | 3.08 | 0.05 |
| S750 | E167P | 8.13 | 1 | 196.1 | 3.23 | 17.39 | 2.59 | 2.87 | 0.03 |
| S751 | N168S | 8.05 | 1.11 | 197.14 | 5.78 | 17.32 | 2.99 | 3.07 | 0.1 |
| S752 | S170T | 6.78 | 0.49 | 245.1 | 2.72 | 17.83 | 1.33 | 3.14 | 0.03 |
| S753 | L171I | 7.33 | 0.75 | 245.44 | 7.43 | 19.46 | 2.48 | 3.01 | 0.03 |
| S754 | A172V | 7.07 | 0.83 | 205.35 | 12.64 | 15.67 | 2.5 | 2.75 | 0.07 |
| S755 | Y175F | 6.68 | 0.67 | 198.7 | 1.66 | 14.25 | 1.61 | 3.04 | 0.04 |
| S756 | C180A | 7.54 | 1.49 | 184.86 | 2.91 | 15.09 | 3.08 | 2.82 | 0.04 |
| S757 | A181V | 8.89 | 0.95 | 198.25 | 6.26 | 19.37 | 2.42 | 2.8 | 0.05 |
| S758 | N196Q | 7.5 | 0.64 | 234.66 | 3.74 | 19.04 | 1.81 | 3 | 0.03 |
| S759 | N196T | 7.25 | 0.81 | 232.71 | 1.82 | 18.2 | 2.2 | 3.02 | 0.11 |
| S760 | N196V | 6.65 | 0.23 | 221.97 | 2.92 | 15.81 | 0.65 | 3.04 | 0.04 |
| S761 | H208T | 6.86 | 0.79 | 196.07 | 5.31 | 14.45 | 1.91 | 2.98 | 0.03 |
| S762 | A235P | 7 | 0.16 | 218.66 | 2.12 | 17.79 | 1.47 | 2.95 | 0.02 |
| S763 | A250T | 7.63 | 0.79 | 178.38 | 7.71 | 14.76 | 1.96 | 2.91 | 0.01 |
| S764 | M256V | 14.05 | 2 | 196.25 | 5.09 | 32.23 | 5.93 | 2.83 | 0.02 |
| S765 | K260C | 7.5 | 1.02 | 226.92 | 19.8 | 18.42 | 3.11 | 2.83 | 0.03 |
| S766 | K260W | 6.47 | 0.51 | 220.7 | 11.96 | 15.22 | 0.69 | 2.94 | 0.07 |
| S767 | L268I | 7.59 | 0.55 | 233.68 | 6.98 | 19.19 | 1.46 | 2.78 | 0.03 |
| S768 | H309V | 8.84 | 0.74 | 172.01 | 32.73 | 16.46 | 1.8 | 2.8 | 0.14 |
| S769 | T310A | 9.23 | 0.85 | 217.24 | 4.54 | 22.07 | 1.92 | 2.74 | 0.06 |
| S770 | T310C | 9.62 | 0.51 | 213.55 | 8.72 | 22.79 | 2.2 | 2.76 | 0.04 |
| S771 | F316Y | 8.74 | 0.71 | 231.8 | 8.9 | 22.23 | 2.24 | 2.72 | 0.07 |
| S772 | L326I | 8.73 | 0.72 | 213.73 | 6.82 | 20.42 | 1.34 | 2.75 | 0.05 |
| S773 | G378T | 6.6 | 0.81 | 201.39 | 1.94 | 14.23 | 1.78 | 2.8 | 0.04 |
| S774 | G378S | 7.95 | 1.38 | 199.74 | 6.91 | 17.3 | 3.44 | 2.75 | 0.03 |
| S775 | K389E | 7.09 | 0.81 | 191.7 | 6.09 | 14.63 | 1.66 | 2.91 | 0.04 |
| S776 | E406K | ND | ND | ND | ND | ND | ND | ND | ND |
| S777 | S428L | 8.5 | 0.52 | 206.13 | 1.8 | 19.16 | 1.41 | 2.74 | 0.02 |
| S778 | L439M | 7.43 | 1.06 | 180.84 | 5.67 | 14.54 | 2.36 | 2.89 | 0.06 |
| S779 | N466D | 8.21 | 0.96 | 190.55 | 5.45 | 17.05 | 2.23 | 2.84 | 0.07 |
| S780 | K474S | 7.21 | 0.75 | 172.35 | 3.06 | 13.41 | 1.64 | 2.79 | 0.09 |
| S781 | Y499M | 7.5 | 0.2 | 203.87 | 4.24 | 16.54 | 0.52 | 2.83 | 0.05 |
| S782 | Y499V | 7.98 | 1.34 | 221.74 | 4.21 | 19.23 | 3.2 | 2.9 | 0.03 |
| S783 | N527E | 8.08 | 0.46 | 213.24 | 2.57 | 18.76 | 1.17 | 3.18 | 0.16 |
| S784 | P538T | 7.11 | 1.97 | 171.35 | 5.64 | 13.14 | 3.83 | 2.88 | 0.03 |
| S785 | R541E | 8.12 | 1.04 | 184.17 | 1.51 | 16.27 | 2.16 | 2.92 | 0.03 |
| S786 | R541V | 8.07 | 0.3 | 190.64 | 8.32 | 16.72 | 0.11 | 2.87 | 0.06 |
| S787 | H542V | 7.87 | 1.72 | 181.8 | 3.47 | 15.63 | 3.92 | 2.84 | 0.05 |
| S788 | R543A | 8.82 | 0.25 | 179.82 | 1.17 | 17.39 | 0.48 | 2.87 | 0.13 |
| S789 | R543E | 6.92 | 1.02 | 201.49 | 2.72 | 14.98 | 2.28 | 2.93 | 0.04 |
| S790 | H544E | 7.89 | 0.6 | 200.67 | 4.27 | 17.23 | 1.76 | 3.01 | 0.05 |
| S791 | H544D | 7.93 | 0.17 | 194.86 | 16.01 | 16.78 | 1.53 | 3.03 | 0.11 |
| S1100 | NA (WT) | 8.43 | 0.86 | 51.81 | 8.72 | 4.76 | 8.72 | 3.23 | 0.18 |
| S1101 | R31Q | 8.33 | 1.07 | 69.58 | 6.39 | 6.36 | 6.39 | 3.2 | 0.15 |
| S1102 | L49E | 8.58 | 0.85 | 86.97 | 9.15 | 8.11 | 9.15 | 3.35 | 0.06 |
| S1103 | L71H | 7.92 | 0.8 | 44 | 5.9 | 3.79 | 5.9 | 3.37 | 0.3 |
| S1104 | M61H | 8.97 | 1.46 | 36.4 | 2.91 | 3.6 | 2.91 | 3.46 | 0.26 |
| S1105 | M61W | 9.01 | 0.53 | 42.06 | 4.75 | 4.18 | 4.75 | 3.6 | 0.21 |
| S1106 | L132M | 9.37 | 1.6 | 60.99 | 11.57 | 6.26 | 11.57 | 3.55 | 0.4 |
| S1107 | V149I | 8.17 | 1.68 | 40.67 | 6.74 | 3.64 | 6.74 | 3.33 | 0.19 |
| S1108 | S170T | 7.91 | 0.93 | 141.99 | 10.56 | 12.19 | 10.56 | 3.41 | 0.26 |
| S1109 | L171I | 7.96 | 0.96 | 126.11 | 12.35 | 10.9 | 12.35 | 3.51 | 0.14 |
| S1110 | Y175F | 7.84 | 0.8 | 103.07 | 12.66 | 8.75 | 12.66 | 3.39 | 0.26 |
| S1111 | N196Q | 8.47 | 0.79 | 88.61 | 18.38 | 8.1 | 18.38 | 3.5 | 0.26 |
| S1112 | N196T | 8 | 0.66 | 73.5 | 10.73 | 6.4 | 10.73 | 3.73 | 0.23 |
| S1113 | N196V | 7.51 | 1.34 | 86.16 | 11.2 | 7.15 | 11.2 | 4.29 | 0.68 |
| S1114 | H208T | 8.96 | 1.82 | 40.13 | 5.26 | 3.92 | 5.26 | 3.28 | 0.3 |
| S1115 | K260W | 7.83 | 1.11 | 100.95 | 14.49 | 8.54 | 14.49 | 3.42 | 0.14 |
| S1116 | L268I | 8.4 | 0.66 | 62.7 | 8.31 | 5.74 | 8.31 | 3.47 | 0.06 |
| S1117 | F316Y | 8.22 | 0.78 | 93.97 | 9.12 | 8.41 | 9.12 | 3.47 | 0.28 |
| S1118 | G378T | 6.58 | 1.16 | 106.8 | 12.83 | 7.5 | 12.83 | 3.36 | 0.17 |
| S1119 | N527E | 7.3 | 0.82 | 90.02 | 9.59 | 7.1 | 9.59 | 3.33 | 0.18 |
| S1120 | R543E | 8.69 | 1.17 | 47.9 | 7.48 | 4.54 | 7.48 | 3.28 | 0.28 |

(ND = Not Done)

TABLE 4

| Non-competition Assay | | | | | | | | | | | |
|---|---|---|---|---|---|---|---|---|---|---|---|
| | | | CBDA mg/L | | THCA mg/L | | THCA % | CBCA mg/L | | CBCA % |
| Exp* | Strain** | Mutation | Avg | StdDev | Avg | StdDev | Avg | Avg | StdDev | Avg |
| 1 | S579 | NA | 204.03 | 9.82 | 24.07 | 2.36 | 10.54 | ND | ND | ND |
| 1 | S935 | I445M | 94.42 | 6.67 | 6.48 | 1.34 | 6.42 | ND | ND | ND |
| 1 | S938 | M412Q | 88.52 | 17.46 | 9.01 | 2.41 | 9.21 | ND | ND | ND |
| 1 | S940 | L415M | 173.12 | 6.85 | 17.2 | 1.77 | 9.04 | ND | ND | ND |
| 1 | S941 | D115N | 61.26 | 8.32 | 13.09 | 1.53 | 17.66 | ND | ND | ND |
| 1 | S942 | A414T | 68.63 | 3.55 | 23.32 | 1.99 | 25.34 | ND | ND | ND |
| 1 | S943 | A414T | 75.63 | 8.2 | 26.77 | 4.04 | 26.11 | ND | ND | ND |
| 1 | S944 | A414V | 188.19 | 20.16 | 81.2 | 13.23 | 30.05 | ND | ND | ND |
| 1 | S945 | A414M | 73.07 | 7.2 | 40.3 | 2.61 | 35.64 | ND | ND | ND |
| 1 | S946 | A414M | 66.57 | 3.37 | 42.35 | 4.07 | 38.83 | ND | ND | ND |
| 2 | S579 | NA | 211.17 | 14 | 19.23 | 2.24 | 8.33 | ND | ND | ND |
| 2 | S935 | I445M | 105.31 | 6.27 | 4.98 | 0.75 | 4.51 | ND | ND | ND |
| 3 | S1205 | M61W, G378T | 174.13 | 26.9 | 10.97 | 2.17 | 5.9 | 33.36 | 4.66 | 15.27 |
| 3 | S1206 | M61W, K389E | 186.82 | 13.84 | 15.56 | 1.11 | 7.7 | 17.78 | 1.52 | 8.08 |
| 3 | S1207 | G378T, K389E | 199.96 | 9.91 | 12.91 | 1.41 | 6.06 | 35.4 | 1.75 | 14.26 |
| 3 | S1208 | M61W, G378T, K389E | 192.82 | 7.36 | 12.88 | 1.16 | 6.26 | 38.35 | 1.9 | 15.71 |
| 3 | S579 | NA | 173.53 | 5.9 | 14.49 | 0.66 | 7.71 | 13.72 | 1.4 | 6.80 |
| 3 | S935 | I445M | 85.24 | 7.62 | 3.1 | 0.65 | 3.51 | 4.56 | 0.72 | 4.91 |
| 3 | S975 | L171I | 228.93 | 11.96 | 18.48 | 0.86 | ND | 20.91 | 2.22 | 7.79 |
| 4 | S579 | NA | 198.61 | 12.07 | 16.66 | 1.41 | ND | 17.54 | 1.6 | 7.53 |
| 4 | S935 | I445M | 99 | 13.2 | 3.43 | 1.26 | ND | 4.98 | 1.23 | 4.64 |
| 4 | S975 | L171I | 257.02 | 19.41 | 22.13 | 2.78 | ND | 25.63 | 3.38 | 8.41 |

(n = 4 or greater for all data in Table 4; ND = Not Done)

*Absolute values and %THCA can vary by experiment, so values should be compared to their same experiment control. Four separate experiments were conducted and each group is indicated in the "Exp" column.

**Where multiple strains have the same mutation (e.g., S942, S943), they represent different transformation clones that were compared

GENERAL METHODS OF THE EXAMPLES

Yeast Transformation Methods

Each DNA construct comprising one or more heterologous nucleic acids disclosed herein (e.g., constructs detailed in Table 5) was integrated into *Saccharomyces cerevisiae* (CEN.PK2, Strain S4) with standard molecular biology techniques in an optimized lithium acetate (LiAc) transformation. Briefly, cells were grown overnight in yeast extract peptone dextrose (YPD) media at 30° C. with shaking (200 rpm), diluted to an OD600 of 0.175 in YPD, and grown to an OD600 of 0.6-0.8. Transformations were conducted in 96 well plate format, using 1.67 mL of culture per well. The total culture volume was harvested by centrifugation, washed in equivalent volume of sterile water, spun down again, and washed in equivalent volume 100 mM LiAc. Cells were spun down again, the supernatant was removed, and the cells were resuspended in a transformation mix consisting of 80 μL 50% PEG, 12 μL 1M LiAc, 3.3 μL boiled salmon sperm DNA, 5 μL of PCR amplified library DNA, and 19.7 μL of water (scaled by number of transformations). Following a heat shock at 42° C. for 40 minutes, cells were recovered overnight in YPD media before plating on selective media. DNA integration was confirmed by colony PCR with primers specific to the integrations for a sample of colonies to confirm high rates of integration.

Yeast Culturing Conditions

Yeast colonies comprising library construct nucleic acids disclosed herein, modified host cells, were picked into 96-well microtiter plates containing 360 μL of YPD (10 g/L yeast extract, 20 g/L Bacto peptone, 20 g/L dextrose (glucose)) and sealed with a breathable film seal. Cells were cultured at 30° C. in a high capacity microtiter plate incubator shaking at 1000 rpm and 80% humidity for 2 days (termed "pre-culture") until the cultures reached carbon exhaustion. The growth-saturated cultures were subcultured into fresh plates containing YPGAL and either olivetolic acid or hexanoic acid, or an olivetolic acid derivative or a carboxylic acid other than hexanoic acid (10 g/L yeast extract, 20 g/L Bacto peptone, 20 or 40 g/L galactose, 1 g/L glucose and either 1 mM olivetolic acid or 2 mM hexanoic acid, or 1 mM of an olivetolic acid derivative or 2 mM of a carboxylic acid other than hexanoic acid), by taking 15 μL from the saturated cultures and diluting into 360 of fresh media and sealed with a breathable film seal. Modified host cells in the production media were cultured at 30° C. in a high capacity microtiter plate shaker at 1000 rpm and 80% humidity for an additional 5 days prior to extraction and analysis. Upon completion, 25 μL of whole cell broth was diluted into 975 μL of methanol, sealed with a foil seal, and shaken at 1200 rpm for 60 seconds to extract the cannabinoids or cannabinoid derivatives. After shaking, the plate was centrifuged at 1000×g for 60 seconds to remove any solids. After centrifugation, the seal was removed and 10 μL of supernatant was transferred to a fresh assay plate containing 240 μL of methanol, sealed with a foil seal, shaken for 60 seconds at 900 rpm, and analyzed by LC-MS.

Analytical Methods

Samples were analyzed by LC-MS mass spectrometer (Agilent 6470) using a Phenomenex Kinetex Phenyl-Hexyl 2.1×30 mm, 2.6 μm analytical column with the following gradient (Mobile Phase A: LC-MS grade water with 0.1% formic acid; Mobile Phase B: LC-MS grade acetonitrile with 0.1% formic acid):

| Time (minutes) | % B |
|---|---|
| 0 | 40 |
| 0.1 | 40 |
| 0.55 | 58 |
| 1.45 | 58 |
| 1.46 | 40 |
| 1.75 | 40 |

The mass spectrometer was operated in negative ion multiple reaction-monitoring mode. Each cannabinoid or cannabinoid derivative was identified by retention time, determined from an authentic standard, and multiple reaction monitoring (MRM) transition:

| Compound Name | Q1 Mass (Da) | Q3 Mass (Da) | Collision Energy (V) |
|---|---|---|---|
| CBGA | 359.2 | 341.1 | 22 |
| CBGA | 359.2 | 315.2 | 22 |
| CBDA | 357.2 | 339.1 | 22 |
| CBDA | 357.2 | 245.1 | 30 |
| CBCA | 357.2 | 203.0 | 40 |
| CBCA | 357.2 | 191.0 | 30 |
| THCA | 357.0 | 245.0 | 35 |
| THCA | 357.0 | 191.0 | 35 |

Recovery and Purifications

Whole-cell broth from cultures comprising modified host cells of the disclosure are extracted with a suitable organic solvent to afford cannabinoids or cannabinoid derivatives. Suitable organic solvents include, but are not limited to, hexane, heptane, ethyl acetate, petroleum ether, and di-ethyl ether, chloroform, and ethyl acetate. The suitable organic solvent, such as hexane, is added to the whole-cell broth from fermentations comprising modified host cells of the disclosure at a 10:1 ratio (10 parts whole-cell broth−1 part organic solvent) and stirred for 30 minutes. The organic fraction is separated and extracted twice with an equal volume of acidic water (pH 2.5). The organic layer is then separated and dried in a concentrator (rotary evaporator or thin film evaporator under reduced pressure) to obtain crude cannabinoid or cannabinoid derivative crystals. The crude crystals may then be heated to 105° C. for 15 minutes followed by 145° C. for 55 minutes to decarboxylate the crude cannabinoid or cannabinoid derivative. The crude crystalline product is re-dissolved and recrystallized in a suitable solvent (e.g., n-pentane) and filtered through a 1 μm filter to remove any insoluble material. The solvent is then removed e.g., by rotary evaporation, to produce pure crystalline product.

In Vitro Enzyme Assay and Cell-Free Production of Cannabinoids or Cannabinoid Derivatives In some embodiments, modified host cells, e.g., modified yeast cells are cultured in 96-well microtiter plates containing 360 μL of YPD (10 g/L yeast extract, 20 g/L Bacto peptone, 20 g/L dextrose (glucose)) and sealed with a breathable film seal. Cells are then cultured at 30° C. in a high capacity microtiter plate incubator shaking at 1000 rpm and 80% humidity for 3 days until the cultures reach carbon exhaustion. The growth-saturated cultures are then subcultured into 200 mL of YPGAL media to an OD600 of 0.2 and incubated with shaking for 20 hours at 30° C. Cells are then harvested by centrifugation at 3000×g for 5 minutes at 4° C. Harvested cells are then resuspended in 50 mL buffer (50 mM Tris-HCl, 1 mM EDTA, 0.1 M KCl, pH 7.4, 125 units Benzonase) and then lysed (Emulsiflex C3, Avestin, INC., 60 bar, 10 min). Cells debris is removed by centrifugation (10,000×g, 10 min, 4° C.). Subsequently, the supernatant is then subjected to ultracentrifugation (150,000×g, 1 h, 4° C., Beckman Coulter L-90K, TI-70). The resulting membrane fractions are then resuspended in 3.3 mL buffer (10 mM Tris-HCl, 10 mM MgCl2, pH 8.0, 10% glycerol) and solubilized with a tissue grinder. Then, 0.02% (v/v) of the respective membrane preparations are then dissolved in reaction buffer (50 mM Tris-HCl, 10 mM MgCl2, pH 8.5) and substrate (500 μM olivetolic acid, 500 μM GPP) to a total volume of 50 μL and incubated for 1 hour at 30° C. Assays are then extracted by adding two reaction volumes of ethyl acetate followed by vortexing and centrifugation. The organic layer is evaporated for 30 minutes, resuspended in acetonitrile/H20/formic acid (80:20:0.05%) and filtered with Ultrafree®-MC columns (0.22 μm pore size, PVDF membrane material). Cannabinoids or cannabinoid derivatives are then detected via LC-MS and/or recovered and purified.

Yeast Cultivation in a Bioreactor

Single yeast colonies comprising modified host cells disclosed herein are grown in 15 mL of Verduyn medium (originally described by Verduyn et al, Yeast 8(7): 501-17) with 50 mM succinate (pH 5.0) and 2% glucose in a 125 mL flask at 30° C., with shaking at 200 rpm to an OD600 between 4 to 9. Glycerol is then added to the culture to a concentration of 20% and 1 mL vials of the modified host cell suspension are stored at −80° C. One to two vials of modified host cells are thawed and grown in Verduyn medium with 50 mM succinate (pH 5.0) and 4% sucrose for 24 hours, then sub-cultured to an OD600 reading of 0.1 in the same media. After 24 hours of growth at 30° C. with shaking, 65 mL of culture is used to inoculate a 1.3-liter fermenter (Eppendorf DASGIP Bioreactor) with 585 mL of Verduyn fermentation media containing 20 g/L galactose supplemented with hexanoic acid (2 mM), a carboxylic acid other than hexanoic acid (2 mM), olivetolic acid (1 mM), or an olivetolic acid derivative (1 mM). A poly-alpha-olefin may be added to the fermenter as an extractive agent. The fermenter is maintained at 30° C. and pH 5.0 with addition of $NH_4OH$. In an initial batch phase, the fermenter is aerated at 0.5 volume per volume per minute air (VVM) and agitation ramped to maintain 30% dissolved oxygen. After the initial sugar is consumed, the rise in dissolved oxygen triggers feeding of galactose+hexanoic acid (800 g galactose per liter+9.28 g hexanoic acid per liter) at 10 g galactose per liter per hour in pulses of 10 g galactose per liter doses (alternatively, rather than feeding the modified host cells disclosed herein hexanoic acid, olivetolic acid, an olivetolic acid derivative, or a carboxylic acid other than hexanoic acid is fed to the modified host cells).

Between pulses, the feed rate is lowered to 5 g galactose per liter per hour. Upon a 10% rise in dissolved oxygen, the feed rate is resumed at 10 g $L^{-1}$ $hour^{-1}$. As modified host cell density increases, dissolved oxygen is allowed to reach 0%, and the pulse dose is increased to 50 g galactose per liter. Oxygen transfer rate is maintained at rates representative of full-scale conditions of 100 mM per liter per hour by adjusting agitation as volume increased. Feed rate is adjusted dynamically to meet demand using an algorithm that alternates between a high feed rate and low feed rate. During the low feed rate, modified host cells should consume galactose and hexanoic acid, or, alternatively, olivetolic acid, an olivetolic acid derivative, or a carboxylic acid other than hexanoic acid, and any overflow metabolites accumulated during the high feed rate. A rise in dissolved oxygen triggers the high feed rate to resume. The length of time spent in the low feed rate reflects the extent to which modified host cells are over- or under-fed in the prior high feed rate pulse; this information is then monitored and used to tune the high feed rate up or down, keeping the low feed rate within a defined range.

Over time, the feed rate matches sugar and hexanoic acid, or, alternatively, olivetolic acid, an olivetolic acid derivative, or a carboxylic acid other than hexanoic acid, demand from modified host cells. This algorithm ensures minimal net accumulation of fermentation products other than cannabinoids or cannabinoid derivatives; biomass; and $CO_2$. In some embodiments, the process continues for 5 to 14 days. In certain such embodiments, accumulated broth is removed daily and assayed for biomass and cannabinoid, or cannabinoid derivative concentration. A concentrated solution of $NH_4H_2PO_4$, trace metals and vitamins are added periodically to maintain steady state concentrations.

TABLE 5

Constructs and strains used in the Examples

Figure 1B:
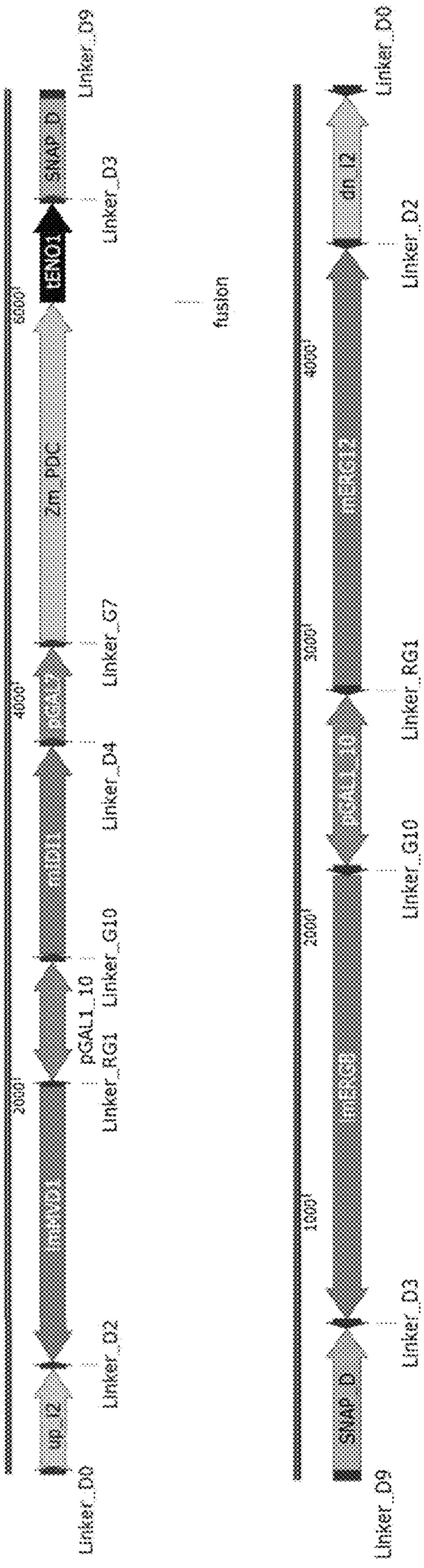
Figure 1C:
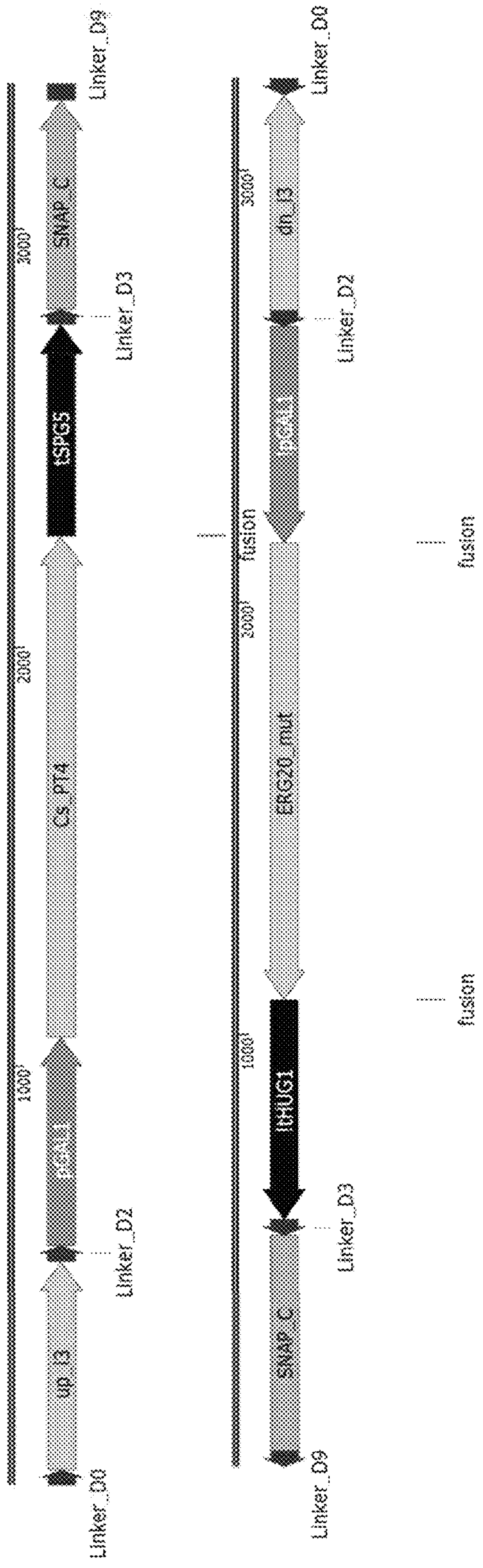
Figure 2:
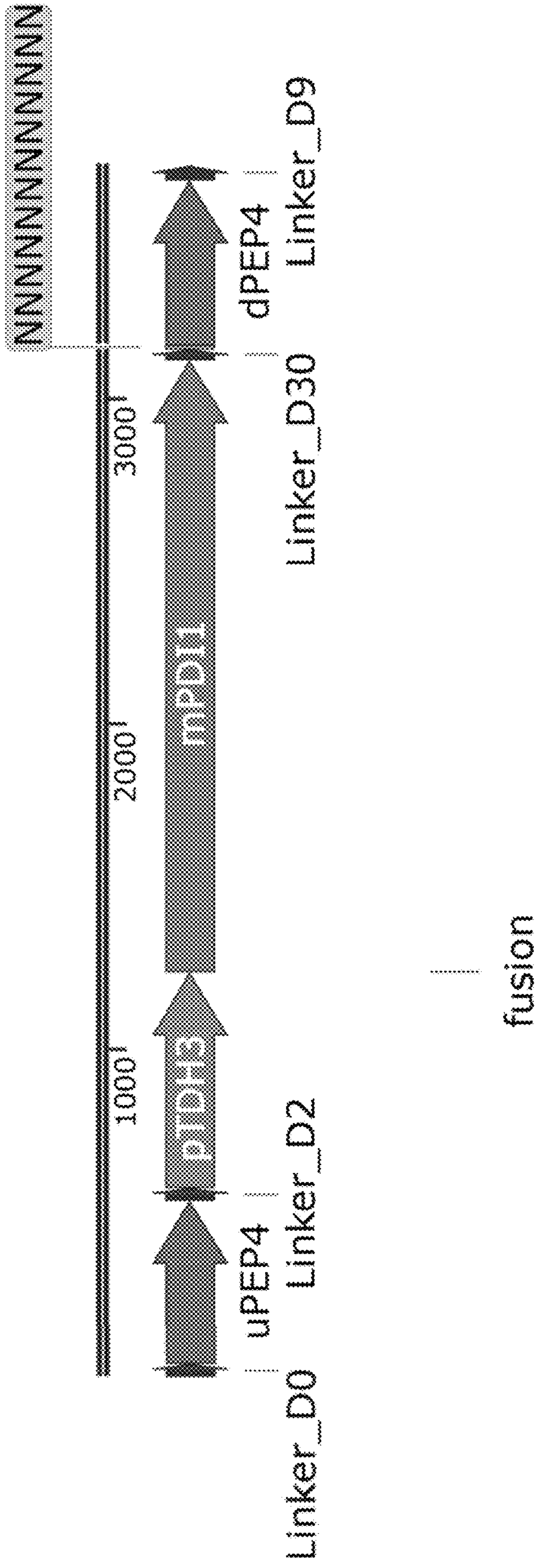
FIG. 2 depicts an expression construct used in the production of the S181 strain. The expression construct depicted in FIG. 2 was also used in the production of following strains: S220, S241, S270, S478, S487, S562, S579, S606-S791, S935, S938, S940-S946, and S1205-S1208.
Figure 3:
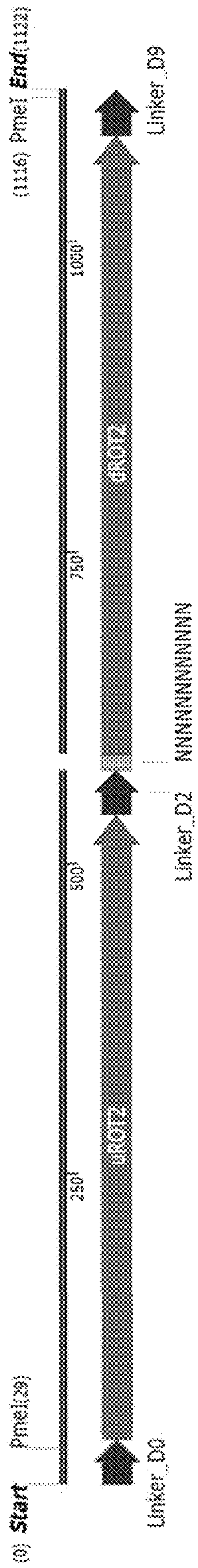
FIG. 3 depicts an expression construct used in the production of the S220 strain. The expression construct depicted in FIG. 3 was also used in the production of following strains: S241, S270, S478, S487, S562, S579, S606-S791, S935, S938, S940-S946, and S1205-S1208.
Figure 4:
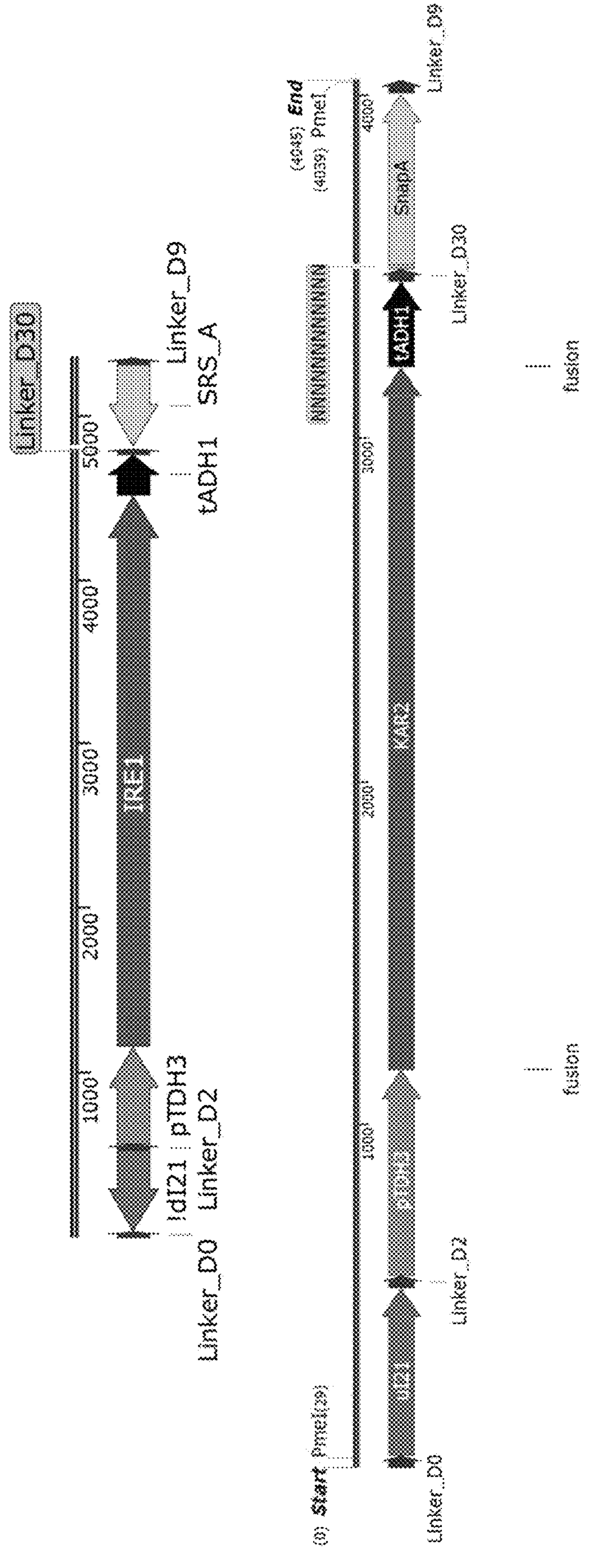
FIG. 4 depicts expression constructs used in the production of the S241 strain. The expression constructs depicted in FIG. 4 were also used in the production of following strains: S270, S478, S487, S562, S579, S606-S791, S935, S938, S940-S946, and S1205-51208.
Figure 5:
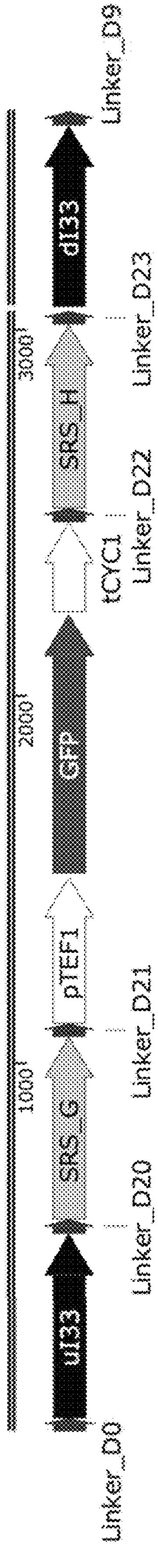
FIG. 5 depicts a landing pad construct used in the production of the S61 strain. The construct depicted in FIG. 5 was also used in the production of the following strains: S122, S171, S181, S220, S241, S270, S478, S487, S562, S579, S606-S791, S935, S938, S940-S946, and S1205-S1208.
Figure 6:
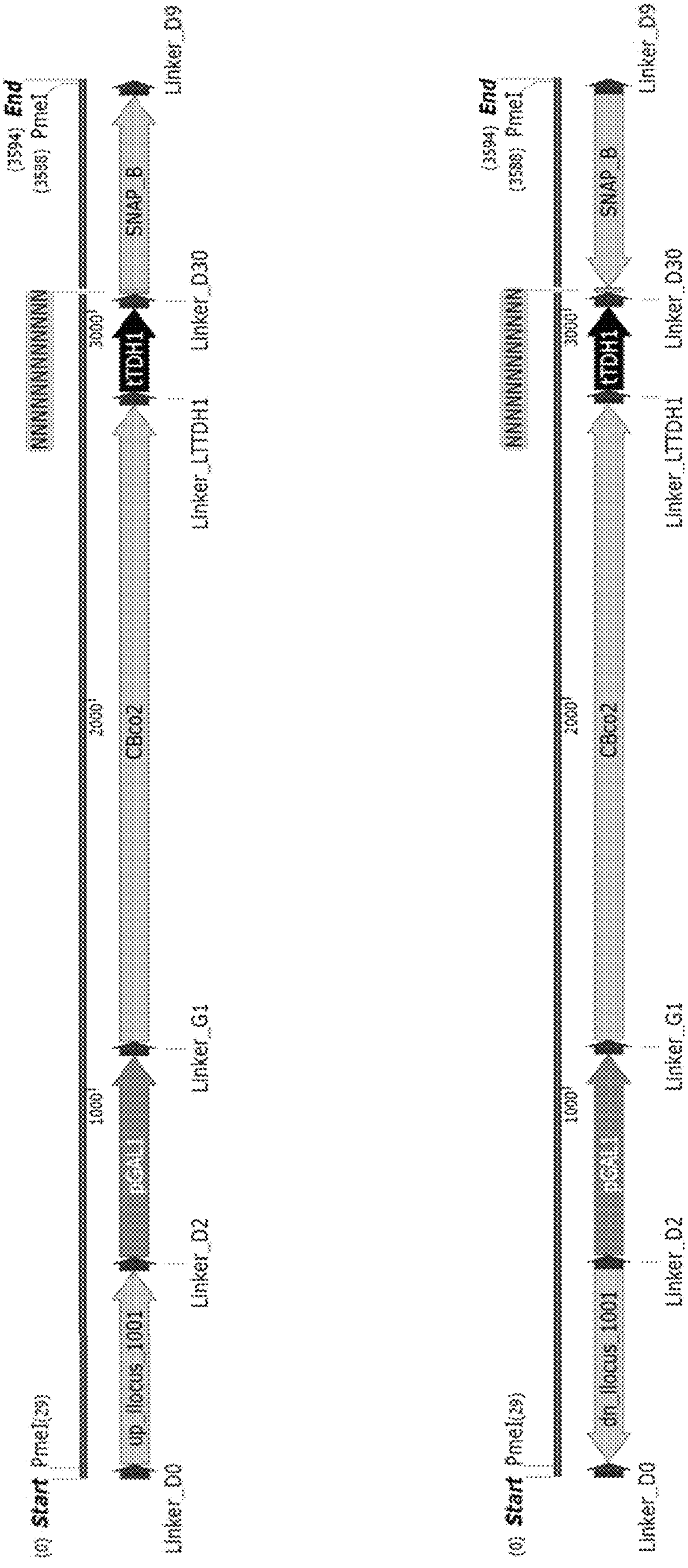
FIG. 6 depicts expression constructs used in the production of the S122 strain. The expression constructs depicted in FIG. 6 were also used in the production of the following strains: S171, S181, S220, S241, S270, S478, S487, S562, S579, S606-S791, S935, S938, S940-S946, and S1205-S1208.
Figure 7:
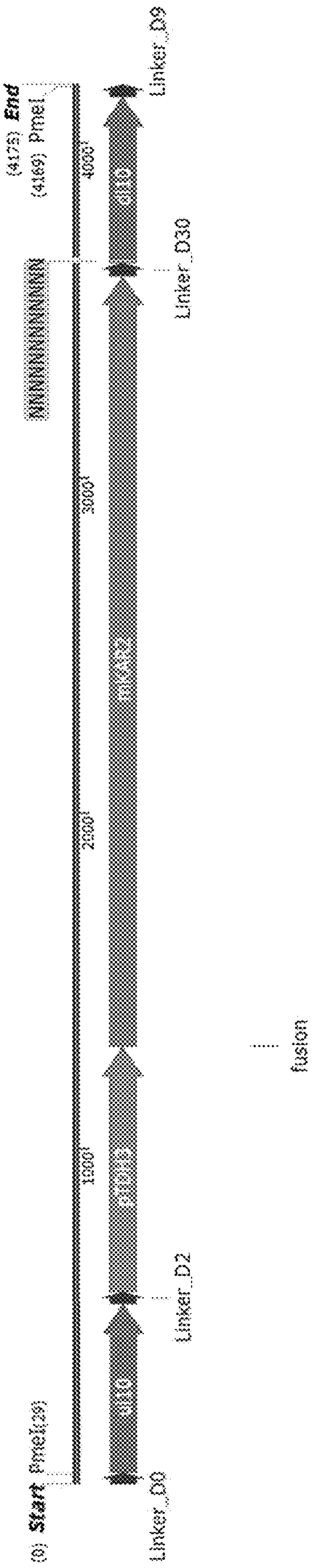
FIG. 7 depicts an expression construct used in the production of the S171 strain. The expression construct depicted in FIG. 7 was also used in the production of the following strains: S181, S220, S241, S270, S478, S487, S562, S579, S606-S791, S935, S938, S940-S946, and S1205-S1208.
Figure 8:
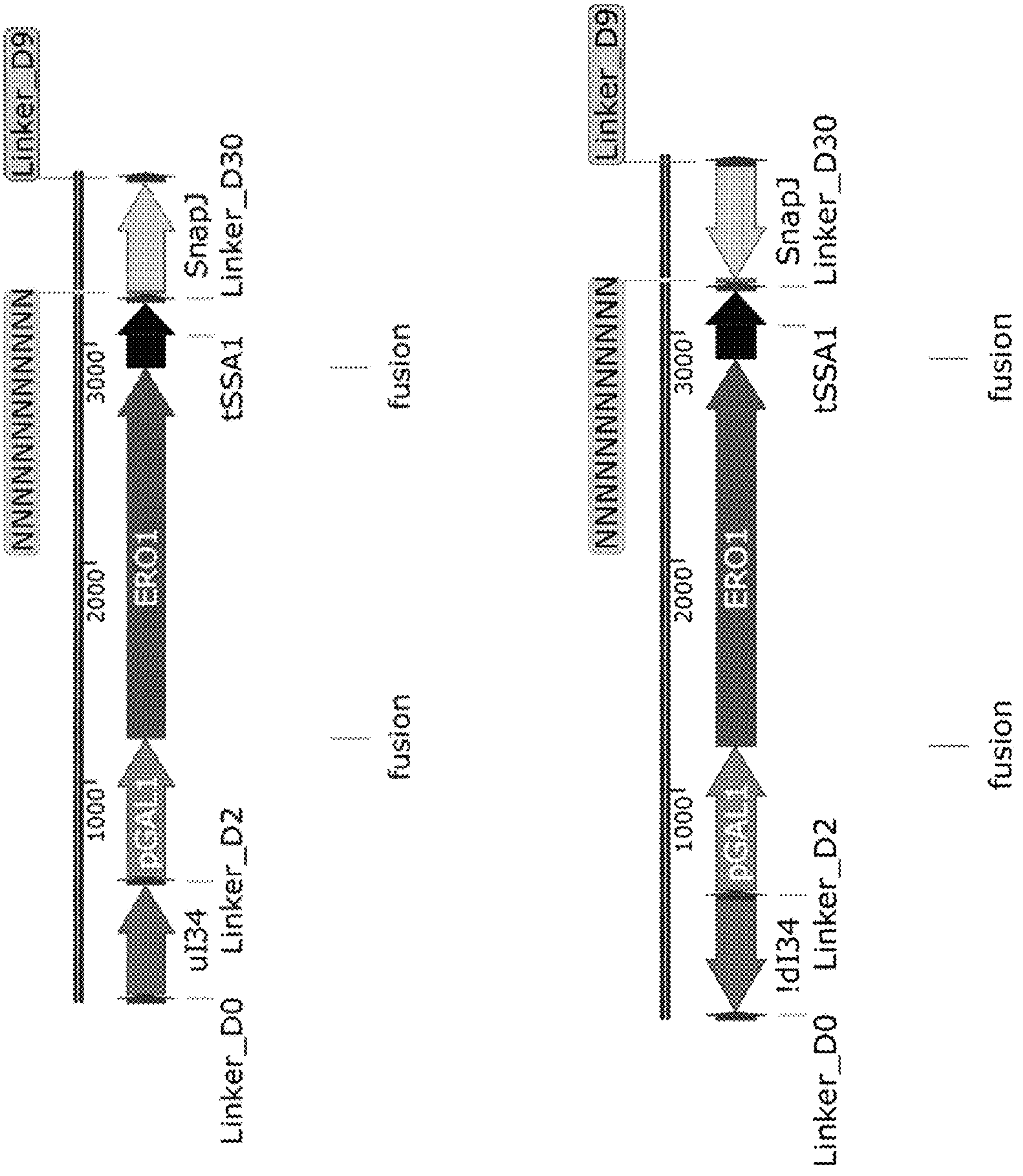
FIG. 8 depicts expression constructs used in the production of the S270 strain. The expression constructs depicted in FIG. 8 were also used in the production of the following strains: S478, S487, S562, S579, S606-S791, S935, S938, S940-S946, and S1205-S1208.
Figure 9:
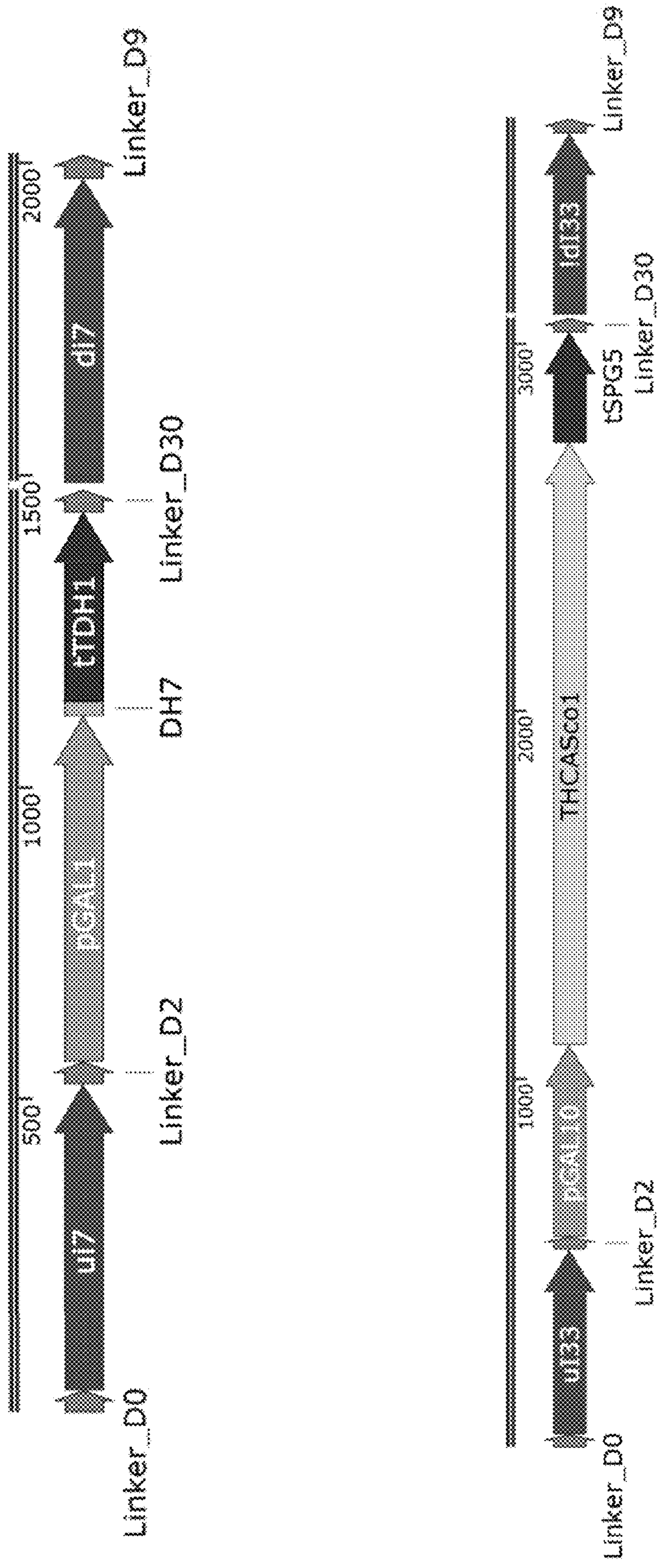
FIG. 9 depicts expression constructs used in the production of the S478 strain. The expression constructs depicted in FIG. 9 were also used in the production of the following strains: S562 and S606-S698.
Figure 10:
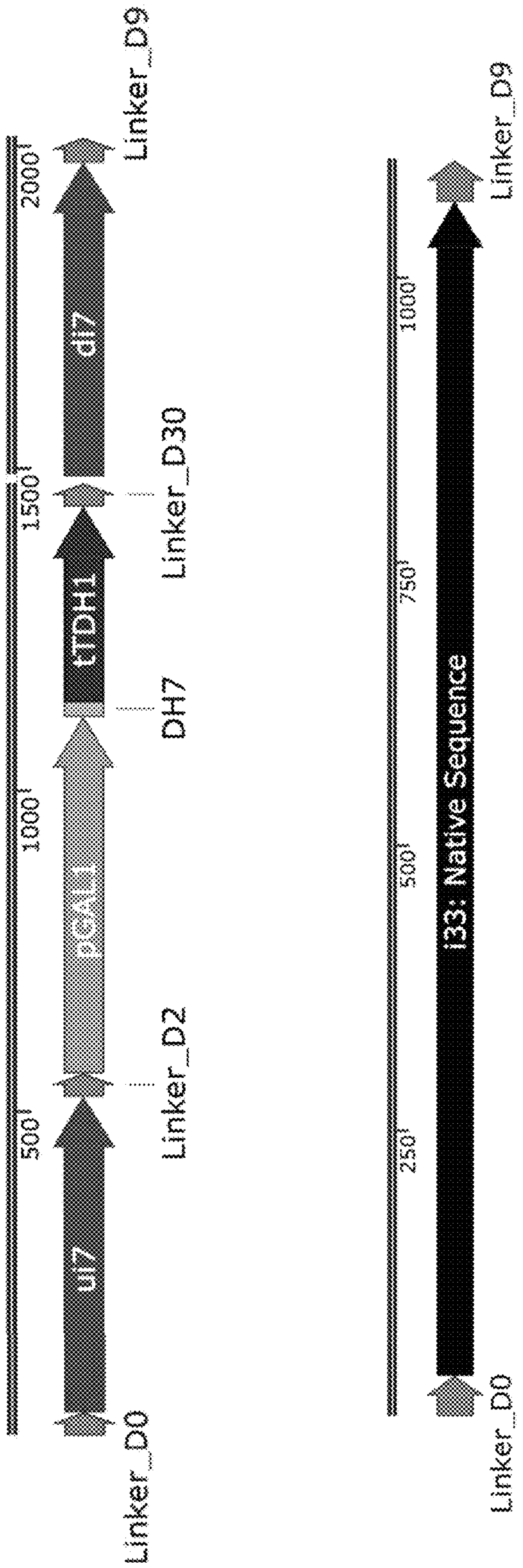
FIG. 10 depicts expression constructs used in the production of the S487 strain. The expression constructs depicted in FIG. 10 were also used in the production of the following strains: S579, S699-S791, S935, S938, S940-S946, and S1205-S1208.
Figure 11:
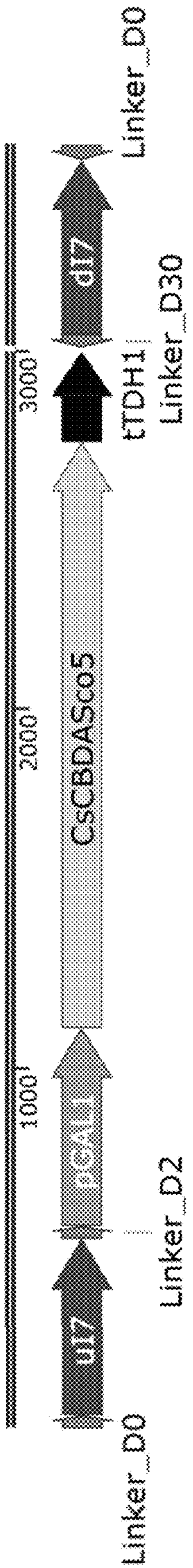
FIG. 11 depicts an expression construct used in the production of the S562, S579, and S1100 strains.
Figure 12:
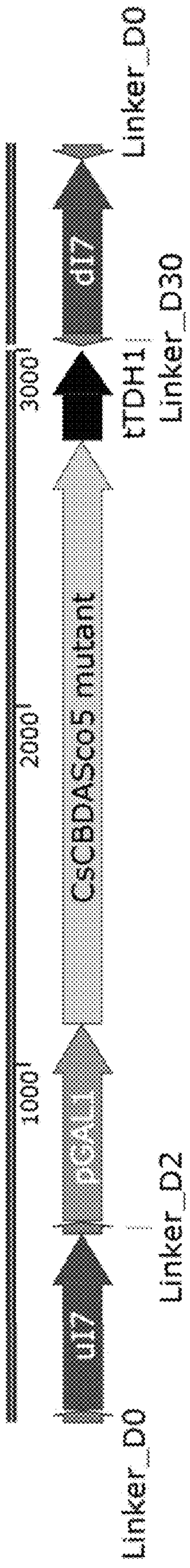
FIG. 12 depicts an expression construct used in the production of the S606-S791, S935, S938, S940-S946, S1101-S1120, and S1205-S1208 strains.
Figure 13A:
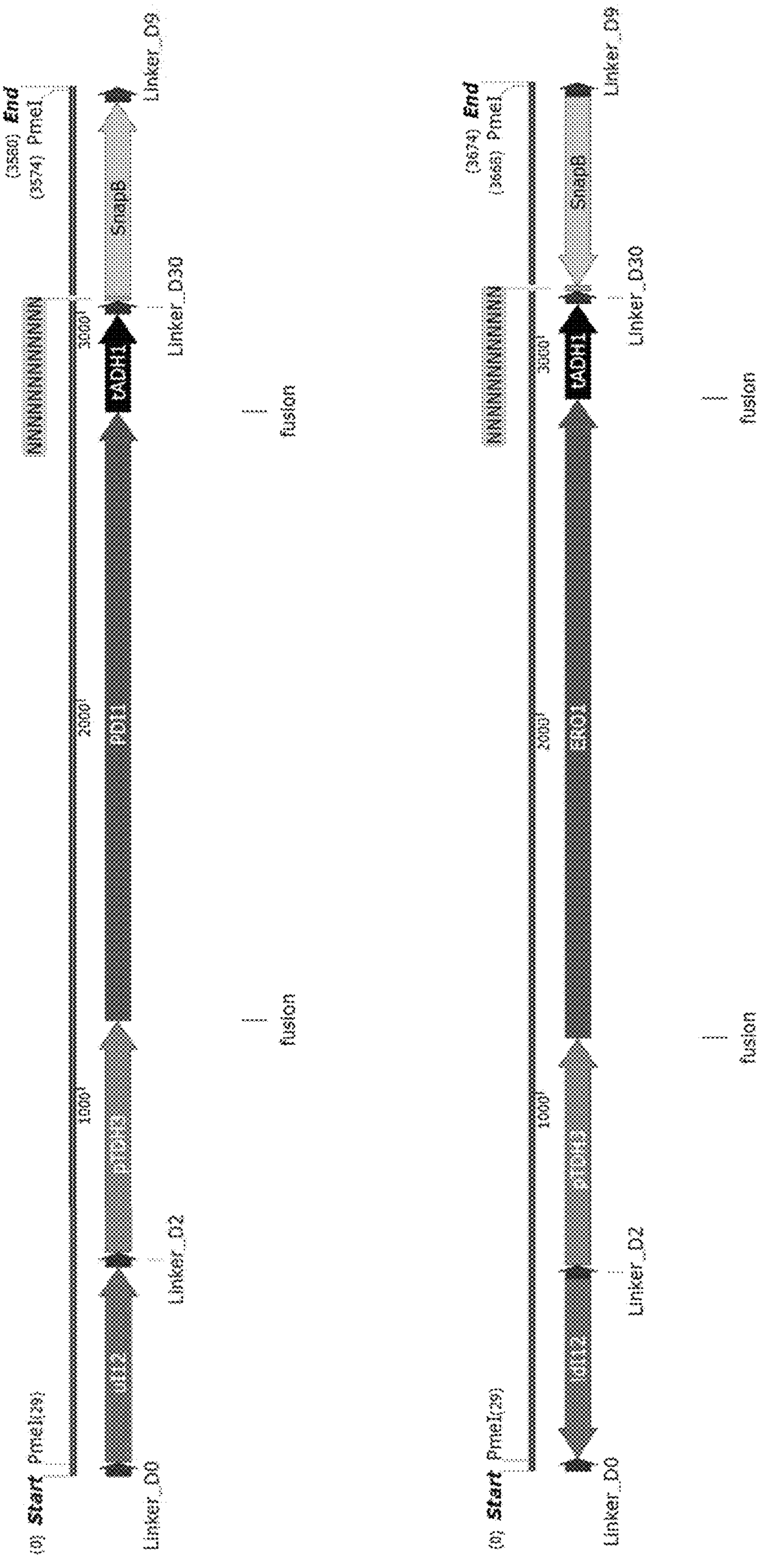
FIGS. 13A and 13B depict expression constructs used in the production of S206. The expression constructs depicted in FIGS. 13A and 13B were also used in the production of following strains: S510 and S1100-S1120.
Figure 13B:
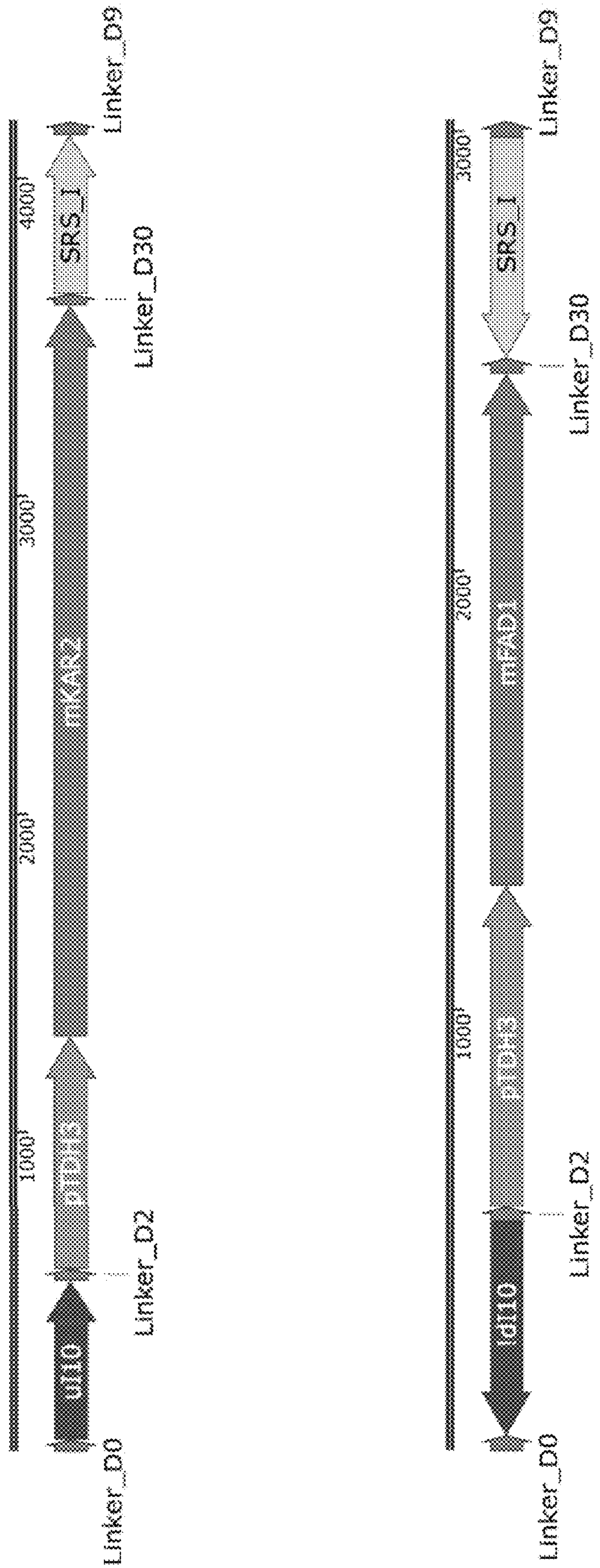
Figure 14:
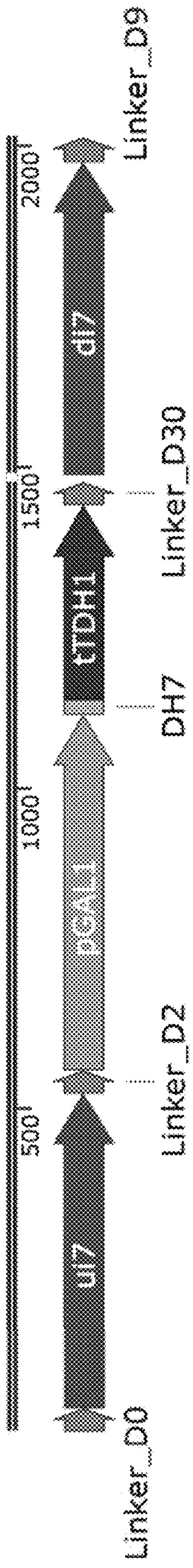
FIG. 14 depicts an expression construct used in the production of the S510 strain. The expression construct depicted in FIG. 14 was also used in the production of the following strains: S1100-S1120.

| Strain (Constructs) | Parent Strain* | Polypeptide SEQ ID NOs (Nucleotide SEQ ID NOs) |
|---|---|---|
| S29 (FIGS. 1A, 1B, and 1C) | S4** | Sc_tHMG1 (tHMGR): SEQ ID NO: 27 (SEQ ID NO: 26)<br>Sc_ERG13 (HMGS): SEQ ID NO: 29 (SEQ ID NO: 28)<br>Sc_ERG10 (acetoacetyl CoA thiolase): SEQ ID NO: 31 (SEQ ID NO: 30)<br>Sc_MVD1 (Sc_ERG19): SEQ ID NO: 33 (SEQ ID NO: 32)<br>Sc_IDI1: SEQ ID NO: 25 (SEQ ID NO: 24)<br>Zm_PDC: SEQ ID NO: 35 (SEQ ID NO: 34)<br>Sc_ERG8 (PMK): SEQ ID NO: 37 (SEQ ID NO: 36)<br>Sc_ERG12 (MK): SEQ ID NO: 39 (SEQ ID NO: 38)<br>Cs_PT4 (GOT): SEQ ID NO: 17 (SEQ ID NO: 16)<br>Sc_ERG20mut (GPPS): SEQ ID NO: 41 (SEQ ID NO: 40) |
| S61 (FIG. 5) | S29 | GFP: SEQ ID NO: 43 (SEQ ID NO: 42) |
| S122 (FIG. 6) | S61 | CBDAS Codon opt 2: SEQ ID NO: 3 (SEQ ID NO: 1) |
| S171 (FIG. 7) | S122 | KAR2: SEQ ID NO: 5 (SEQ ID NO: 4) |
| S181 (FIG. 2) | S171 | PDI1: SEQ ID NO: 9 (SEQ ID NO: 8)<br>pep4: SEQ ID NO: 15 (SEQ ID NO: 14); Deletion or downregulation of |
| S206 (FIGS. 13A and 13B) | S29 | PDI1: SEQ ID NO: 9 (SEQ ID NO: 8)<br>KAR2: SEQ ID NO: 5 (SEQ ID NO: 4)<br>FAD1: SEQ ID NO: 298 (SEQ ID NO: 297)<br>ERO1: SEQ ID NO: 7 (SEQ ID NO: 6) |
| S220 (FIG. 3) | S181 | rot2: SEQ ID NO: 13 (SEQ ID NO: 12); Deletion or downregulation of |
| S241 (FIG. 4) | S220 | KAR2: SEQ ID NO: 5 (SEQ ID NO: 4)<br>IRE1: SEQ ID NO: 296 (SEQ ID NO: 295) |
| S270 (FIG. 8) | S241 | ERO1: SEQ ID NO: 7 (SEQ ID NO: 6) |
| S478 (FIG. 9) *** | S270 | pGAL1_tTDH1: (SEQ ID NO: 46)<br>THCAScol: SEQ ID NO: 44 (SEQ ID NO: 45) |
| S487 (FIG. 10) **** | S270 | pGAL1_tTDH1: (SEQ ID NO: 46)<br>i33: deletion of CBDAS and reversion to native sequence (SEQ ID NO: 323) |
| S510 (FIG. 14) **** | S206 | pGAL1_tTDH1: (SEQ ID NO: 46) |
| S562 (FIG. 11) | S478 | CBDASco5: SEQ ID NO: 3 (SEQ ID NO: 2) |
| S579 (FIG. 11) | S487 | CBDASco5: SEQ ID NO: 3 (SEQ ID NO: 2) |
| S606 (FIG. 12) | S478 | CBDA Synthase C12F: SEQ ID NO: 50 (SEQ ID NO: 49) |
| S607 (FIG. 12) | S478 | CBDA Synthase F17M: SEQ ID NO: 52 (SEQ ID NO: 51) |
| S608 (FIG. 12) | S478 | CBDA Synthase F18T: SEQ ID NO: 54 (SEQ ID NO: 53) |
| S609 (FIG. 12) | S478 | CBDA Synthase F18W: SEQ ID NO: 56 (SEQ ID NO: 55) |
| S610 (FIG. 12) | S478 | CBDA Synthase S20G: SEQ ID NO: 58 (SEQ ID NO: 57) |
| S611 (FIG. 12) | S478 | CBDA Synthase R31Q: SEQ ID NO: 60 (SEQ ID NO: 59) |
| S612 (FIG. 12) | S478 | CBDA Synthase N33K: SEQ ID NO: 62 (SEQ ID NO: 61) |
| S613 (FIG. 12) | S478 | CBDA Synthase P43E: SEQ ID NO: 64 (SEQ ID NO: 63) |

TABLE 5-continued

Constructs and strains used in the Examples

| Strain (Constructs) | Parent Strain* | Polypeptide SEQ ID NOs (Nucleotide SEQ ID NOs) |
|---|---|---|
| S614 (FIG. 12) | S478 | CBDA Synthase L49E: SEQ ID NO: 66 (SEQ ID NO: 65) |
| S615 (FIG. 12) | S478 | CBDA Synthase L49K: SEQ ID NO: 68 (SEQ ID NO: 67) |
| S616 (FIG. 12) | S478 | CBDA Synthase L49Q: SEQ ID NO: 70 (SEQ ID NO: 69) |
| S617 (FIG. 12) | S478 | CBDA Synthase K5OT: SEQ ID NO: 72 (SEQ ID NO: 71) |
| S618 (FIG. 12) | S478 | CBDA Synthase L51I: SEQ ID NO: 74 (SEQ ID NO: 73) |
| S619 (FIG. 12) | S478 | CBDA Synthase Q55E: SEQ ID NO: 76 (SEQ ID NO: 75) |
| S620 (FIG. 12) | S478 | CBDA Synthase Q55P: SEQ ID NO: 78 (SEQ ID NO: 77) |
| S621 (FIG. 12) | S478 | CBDA Synthase N56E: SEQ ID NO: 80 (SEQ ID NO: 79) |
| S622 (FIG. 12) | S478 | CBDA Synthase N57D: SEQ ID NO: 82 (SEQ ID NO: 81) |
| S623 (FIG. 12) | S478 | CBDA Synthase N57E: SEQ ID NO: 84 (SEQ ID NO: 83) |
| S624 (FIG. 12) | S478 | CBDA Synthase L59E: SEQ ID NO: 86 (SEQ ID NO: 85) |
| S625 (FIG. 12) | S478 | CBDA Synthase M61H: SEQ ID NO: 88 (SEQ ID NO: 87) |
| S626 (FIG. 12) | S478 | CBDA Synthase M61S: SEQ ID NO: 90 (SEQ ID NO: 89) |
| S627 (FIG. 12) | S478 | CBDA Synthase M61W: SEQ ID NO: 92 (SEQ ID NO: 91) |
| S628 (FIG. 12) | S478 | CBDA Synthase S62N: SEQ ID NO: 94 (SEQ ID NO: 93) |
| S629 (FIG. 12) | S478 | CBDA Synthase S62Q: SEQ ID NO: 96 (SEQ ID NO: 95) |
| S630 (FIG. 12) | S478 | CBDA Synthase V63M: SEQ ID NO: 98 (SEQ ID NO: 97) |
| S631 (FIG. 12) | S478 | CBDA Synthase S66D: SEQ ID NO: 100 (SEQ ID NO: 99) |
| S632 (FIG. 12) | S478 | CBDA Synthase L71A: SEQ ID NO: 102 (SEQ ID NO: 101) |
| S633 (FIG. 12) | S478 | CBDA Synthase L71H: SEQ ID NO: 104 (SEQ ID NO: 103) |
| S634 (FIG. 12) | S478 | CBDA Synthase L71Q: SEQ ID NO: 106 (SEQ ID NO: 105) |
| S635 (FIG. 12) | S478 | CBDA Synthase S75D: SEQ ID NO: 108 (SEQ ID NO: 107) |
| S636 (FIG. 12) | S478 | CBDA Synthase S75E: SEQ ID NO: 110 (SEQ ID NO: 109) |
| S637 (FIG. 12) | S478 | CBDA Synthase I97V: SEQ ID NO: 112 (SEQ ID NO: 111) |
| S638 (FIG. 12) | S478 | CBDA Synthase L98V: SEQ ID NO: 114 (SEQ ID NO: 113) |
| S639 (FIG. 12) | S478 | CBDA Synthase S100A: SEQ ID NO: 116 (SEQ ID NO: 115) |
| S640 (FIG. 12) | S478 | CBDA Synthase V103A: SEQ ID NO: 118 (SEQ ID NO: 117) |
| S641 (FIG. 12) | S478 | CBDA Synthase V103F: SEQ ID NO: 120 (SEQ ID NO: 119) |
| S642 (FIG. 12) | S478 | CBDA Synthase T109V: SEQ ID NO: 122 (SEQ ID NO: 121) |
| S643 (FIG. 12) | S478 | CBDA Synthase Q124D: SEQ ID NO: 124 (SEQ ID NO: 123) |
| S644 (FIG. 12) | S478 | CBDA Synthase Q124E: SEQ ID NO: 126 (SEQ ID NO: 125) |
| S645 (FIG. 12) | S478 | CBDA Synthase Q124N: SEQ ID NO: 128 (SEQ ID NO: 127) |
| S646 (FIG. 12) | S478 | CBDA Synthase V125E: SEQ ID NO: 130 (SEQ ID NO: 129) |
| S647 (FIG. 12) | S478 | CBDA Synthase V125Q: SEQ ID NO: 132 (SEQ ID NO: 131) |
| S648 (FIG. 12) | S478 | CBDA Synthase I129V: SEQ ID NO: 134 (SEQ ID NO: 133) |
| S649 (FIG. 12) | S478 | CBDA Synthase L132M: SEQ ID NO: 136 (SEQ ID NO: 135) |
| S650 (FIG. 12) | S478 | CBDA Synthase S137G: SEQ ID NO: 138 (SEQ ID NO: 137) |

TABLE 5-continued

Constructs and strains used in the Examples

| Strain (Constructs) | Parent Strain* | Polypeptide SEQ ID NOs (Nucleotide SEQ ID NOs) |
|---|---|---|
| S651 (FIG. 12) | S478 | CBDA Synthase H143D: SEQ ID NO: 140 (SEQ ID NO: 139) |
| S652 (FIG. 12) | S478 | CBDA Synthase V149I: SEQ ID NO: 142 (SEQ ID NO: 141) |
| S653 (FIG. 12) | S478 | CBDA Synthase W161K: SEQ ID NO: 144 (SEQ ID NO: 143) |
| S654 (FIG. 12) | S478 | CBDA Synthase W161R: SEQ ID NO: 146 (SEQ ID NO: 145) |
| S655 (FIG. 12) | S478 | CBDA Synthase W161Y: SEQ ID NO: 148 (SEQ ID NO: 147) |
| S656 (FIG. 12) | S478 | CBDA Synthase K165A: SEQ ID NO: 150 (SEQ ID NO: 149) |
| S657 (FIG. 12) | S478 | CBDA Synthase E167P: SEQ ID NO: 152 (SEQ ID NO: 151) |
| S658 (FIG. 12) | S478 | CBDA Synthase N168S: SEQ ID NO: 154 (SEQ ID NO: 153) |
| S659 (FIG. 12) | S478 | CBDA Synthase S170T: SEQ ID NO: 156 (SEQ ID NO: 155) |
| S660 (FIG. 12) | S478 | CBDA Synthase L171I: SEQ ID NO: 158 (SEQ ID NO: 157) |
| S661 (FIG. 12) | S478 | CBDA Synthase A172V: SEQ ID NO: 160 (SEQ ID NO: 159) |
| S662 (FIG. 12) | S478 | CBDA Synthase Y175F: SEQ ID NO: 162 (SEQ ID NO: 161) |
| S663 (FIG. 12) | S478 | CBDA Synthase C180A: SEQ ID NO: 164 (SEQ ID NO: 163) |
| S664 (FIG. 12) | S478 | CBDA Synthase A181V: SEQ ID NO: 166 (SEQ ID NO: 165) |
| S665 (FIG. 12) | S478 | CBDA Synthase N196Q: SEQ ID NO: 168 (SEQ ID NO: 167) |
| S666 (FIG. 12) | S478 | CBDA Synthase N196T: SEQ ID NO: 170 (SEQ ID NO: 169) |
| S667 (FIG. 12) | S478 | CBDA Synthase N196V: SEQ ID NO: 172 (SEQ ID NO: 171) |
| S668 (FIG. 12) | S478 | CBDA Synthase H208T: SEQ ID NO: 174 (SEQ ID NO: 173) |
| S669 (FIG. 12) | S478 | CBDA Synthase A235P: SEQ ID NO: 176 (SEQ ID NO: 175) |
| S670 (FIG. 12) | S478 | CBDA Synthase A250T: SEQ ID NO: 178 (SEQ ID NO: 177) |
| S671 (FIG. 12) | S478 | CBDA Synthase M256V: SEQ ID NO: 180 (SEQ ID NO: 179) |
| S672 (FIG. 12) | S478 | CBDA Synthase K260C: SEQ ID NO: 182 (SEQ ID NO: 181) |
| S673 (FIG. 12) | S478 | CBDA Synthase K260W: SEQ ID NO: 184 (SEQ ID NO: 183) |
| S674 (FIG. 12) | S478 | CBDA Synthase L268I: SEQ ID NO: 186 (SEQ ID NO: 185) |
| S675 (FIG. 12) | S478 | CBDA Synthase H309V: SEQ ID NO: 188 (SEQ ID NO: 187) |
| S676 (FIG. 12) | S478 | CBDA Synthase T310A: SEQ ID NO: 190 (SEQ ID NO: 189) |
| S677 (FIG. 12) | S478 | CBDA Synthase T310C: SEQ ID NO: 192 (SEQ ID NO: 191) |
| S678 (FIG. 12) | S478 | CBDA Synthase F316Y: SEQ ID NO: 194 (SEQ ID NO: 193) |
| S679 (FIG. 12) | S478 | CBDA Synthase L326I: SEQ ID NO: 196 (SEQ ID NO: 195) |
| S680 (FIG. 12) | S478 | CBDA Synthase G378T: SEQ ID NO: 198 (SEQ ID NO: 197) |
| S681 (FIG. 12) | S478 | CBDA Synthase G378S: SEQ ID NO: 200 (SEQ ID NO: 199) |
| S682 (FIG. 12) | S478 | CBDA Synthase K389E: SEQ ID NO: 202 (SEQ ID NO: 201) |
| S683 (FIG. 12) | S478 | CBDA Synthase E406K: SEQ ID NO: 204 (SEQ ID NO: 203) |
| S684 (FIG. 12) | S478 | CBDA Synthase S428L: SEQ ID NO: 206 (SEQ ID NO: 205) |
| S685 (FIG. 12) | S478 | CBDA Synthase L439M: SEQ ID NO: 208 (SEQ ID NO: 207) |
| S686 (FIG. 12) | S478 | CBDA Synthase N466D: SEQ ID NO: 210 (SEQ ID NO: 209) |
| S687 (FIG. 12) | S478 | CBDA Synthase K474S: SEQ ID NO: 212 (SEQ ID NO: 211) |

TABLE 5-continued

Constructs and strains used in the Examples

| Strain (Constructs) | Parent Strain* | Polypeptide SEQ ID NOs (Nucleotide SEQ ID NOs) |
|---|---|---|
| S688 (FIG. 12) | S478 | CBDA Synthase Y499M: SEQ ID NO: 214 (SEQ ID NO: 213) |
| S689 (FIG. 12) | S478 | CBDA Synthase Y499V: SEQ ID NO: 216 (SEQ ID NO: 215) |
| S690 (FIG. 12) | S478 | CBDA Synthase N527E: SEQ ID NO: 218 (SEQ ID NO: 217) |
| S691 (FIG. 12) | S478 | CBDA Synthase P538T: SEQ ID NO: 220 (SEQ ID NO: 219) |
| S692 (FIG. 12) | S478 | CBDA Synthase R541E: SEQ ID NO: 222 (SEQ ID NO: 221) |
| S693 (FIG. 12) | S478 | CBDA Synthase R541V: SEQ ID NO: 224 (SEQ ID NO: 223) |
| S694 (FIG. 12) | S478 | CBDA Synthase H542V: SEQ ID NO: 226 (SEQ ID NO: 225) |
| S695 (FIG. 12) | S478 | CBDA Synthase R543A: SEQ ID NO: 228 (SEQ ID NO: 227) |
| S696 (FIG. 12) | S478 | CBDA Synthase R543E: SEQ ID NO: 230 (SEQ ID NO: 229) |
| S697 (FIG. 12) | S478 | CBDA Synthase H544E: SEQ ID NO: 232 (SEQ ID NO: 231) |
| S698 (FIG. 12) | S478 | CBDA Synthase H544D: SEQ ID NO: 234 (SEQ ID NO: 233) |
| S699 (FIG. 12) | S487 | CBDA Synthase C12F: SEQ ID NO: 50 (SEQ ID NO: 49) |
| S700 (FIG. 12) | S487 | CBDA Synthase F17M: SEQ ID NO: 52 (SEQ ID NO: 51) |
| S701 (FIG. 12) | S487 | CBDA Synthase F18T: SEQ ID NO: 54 (SEQ ID NO: 53) |
| S702 (FIG. 12) | S487 | CBDA Synthase F18W: SEQ ID NO: 56 (SEQ ID NO: 55) |
| S703 (FIG. 12) | S487 | CBDA Synthase S20G: SEQ ID NO: 58 (SEQ ID NO: 57) |
| S704 (FIG. 12) | S487 | CBDA Synthase R31Q: SEQ ID NO: 60 (SEQ ID NO: 59) |
| S705 (FIG. 12) | S487 | CBDA Synthase N33K: SEQ ID NO: 62 (SEQ ID NO: 61) |
| S706 (FIG. 12) | S487 | CBDA Synthase P43E: SEQ ID NO: 64 (SEQ ID NO: 63) |
| S707 (FIG. 12) | S487 | CBDA Synthase L49E: SEQ ID NO: 66 (SEQ ID NO: 65) |
| S708 (FIG. 12) | S487 | CBDA Synthase L49K: SEQ ID NO: 68 (SEQ ID NO: 67) |
| S709 (FIG. 12) | S487 | CBDA Synthase L49Q: SEQ ID NO: 70 (SEQ ID NO: 69) |
| S710 (FIG. 12) | S487 | CBDA Synthase K50T: SEQ ID NO: 72 (SEQ ID NO: 71) |
| S711 (FIG. 12) | S487 | CBDA Synthase L51I: SEQ ID NO: 74 (SEQ ID NO: 73) |
| S712 (FIG. 12) | S487 | CBDA Synthase Q55E: SEQ ID NO: 76 (SEQ ID NO: 75) |
| S713 (FIG. 12) | S487 | CBDA Synthase Q55P: SEQ ID NO: 78 (SEQ ID NO: 77) |
| S714 (FIG. 12) | S487 | CBDA Synthase N56E: SEQ ID NO: 80 (SEQ ID NO: 79) |
| S715 (FIG. 12) | S487 | CBDA Synthase N57D: SEQ ID NO: 82 (SEQ ID NO: 81) |
| S716 (FIG. 12) | S487 | CBDA Synthase N57E: SEQ ID NO: 84 (SEQ ID NO: 83) |
| S717 (FIG. 12) | S487 | CBDA Synthase L59E: SEQ ID NO: 86 (SEQ ID NO: 85) |
| S718 (FIG. 12) | S487 | CBDA Synthase M61H: SEQ ID NO: 88 (SEQ ID NO: 87) |
| S719 (FIG. 12) | S487 | CBDA Synthase M61S: SEQ ID NO: 90 (SEQ ID NO: 89) |
| S720 (FIG. 12) | S487 | CBDA Synthase M61W: SEQ ID NO: 92 (SEQ ID NO: 91) |
| S721 (FIG. 12) | S487 | CBDA Synthase S62N: SEQ ID NO: 94 (SEQ ID NO: 93) |
| S722 (FIG. 12) | S487 | CBDA Synthase S62Q: SEQ ID NO: 96 (SEQ ID NO: 95) |
| S723 (FIG. 12) | S487 | CBDA Synthase V63M: SEQ ID NO: 98 (SEQ ID NO: 97) |
| S724 (FIG. 12) | S487 | CBDA Synthase S66D: SEQ ID NO: 100 (SEQ ID NO: 99) |

TABLE 5-continued

| Constructs and strains used in the Examples | | |
|---|---|---|
| Strain (Constructs) | Parent Strain* | Polypeptide SEQ ID NOs (Nucleotide SEQ ID NOs) |
| S725 (FIG. 12) | S487 | CBDA Synthase L71A: SEQ ID NO: 102 (SEQ ID NO: 101) |
| S726 (FIG. 12) | S487 | CBDA Synthase L71H: SEQ ID NO: 104 (SEQ ID NO: 103) |
| S727 (FIG. 12) | S487 | CBDA Synthase L71Q: SEQ ID NO: 106 (SEQ ID NO: 105) |
| S728 (FIG. 12) | S487 | CBDA Synthase S75D: SEQ ID NO: 108 (SEQ ID NO: 107) |
| S729 (FIG. 12) | S487 | CBDA Synthase S75E: SEQ ID NO: 110 (SEQ ID NO: 109) |
| S730 (FIG. 12) | S487 | CBDA Synthase I97V: SEQ ID NO: 112 (SEQ ID NO: 111) |
| S731 (FIG. 12) | S487 | CBDA Synthase L98V: SEQ ID NO: 114 (SEQ ID NO: 113) |
| S732 (FIG. 12) | S487 | CBDA Synthase S100A: SEQ ID NO: 116 (SEQ ID NO: 115) |
| S733 (FIG. 12) | S487 | CBDA Synthase V103A: SEQ ID NO: 118 (SEQ ID NO: 117) |
| S734 (FIG. 12) | S487 | CBDA Synthase V103F: SEQ ID NO: 120 (SEQ ID NO: 119) |
| S735 (FIG. 12) | S487 | CBDA Synthase T109V: SEQ ID NO: 122 (SEQ ID NO: 121) |
| S736 (FIG. 12) | S487 | CBDA Synthase Q124D: SEQ ID NO: 124 (SEQ ID NO: 123) |
| S737 (FIG. 12) | S487 | CBDA Synthase Q124E: SEQ ID NO: 126 (SEQ ID NO: 125) |
| S738 (FIG. 12) | S487 | CBDA Synthase Q124N: SEQ ID NO: 128 (SEQ ID NO: 127) |
| S739 (FIG. 12) | S487 | CBDA Synthase V125E: SEQ ID NO: 130 (SEQ ID NO: 129) |
| S740 (FIG. 12) | S487 | CBDA Synthase V125Q: SEQ ID NO: 132 (SEQ ID NO: 131) |
| S741 (FIG. 12) | S487 | CBDA Synthase I129V: SEQ ID NO: 134 (SEQ ID NO: 133) |
| S742 (FIG. 12) | S487 | CBDA Synthase L132M: SEQ ID NO: 136 (SEQ ID NO: 135) |
| S743 (FIG. 12) | S487 | CBDA Synthase S137G: SEQ ID NO: 138 (SEQ ID NO: 137) |
| S744 (FIG. 12) | S487 | CBDA Synthase H143D: SEQ ID NO: 140 (SEQ ID NO: 139) |
| S745 (FIG. 12) | S487 | CBDA Synthase V149I: SEQ ID NO: 142 (SEQ ID NO: 141) |
| S746 (FIG. 12) | S487 | CBDA Synthase W161K: SEQ ID NO: 144 (SEQ ID NO: 143) |
| S747 (FIG. 12) | S487 | CBDA Synthase W161R: SEQ ID NO: 146 (SEQ ID NO: 145) |
| S748 (FIG. 12) | S487 | CBDA Synthase W161Y: SEQ ID NO: 148 (SEQ ID NO: 147) |
| S749 (FIG. 12) | S487 | CBDA Synthase K165A: SEQ ID NO: 150 (SEQ ID NO: 149) |
| S750 (FIG. 12) | S487 | CBDA Synthase E167P: SEQ ID NO: 152 (SEQ ID NO: 151) |
| S751 (FIG. 12) | S487 | CBDA Synthase N168S: SEQ ID NO: 154 (SEQ ID NO: 153) |
| S752 (FIG. 12) | S487 | CBDA Synthase S170T: SEQ ID NO: 156 (SEQ ID NO: 155) |
| S753 (FIG. 12) | S487 | CBDA Synthase L171I: SEQ ID NO: 158 (SEQ ID NO: 157) |
| S754 (FIG. 12) | S487 | CBDA Synthase A172V: SEQ ID NO: 160 (SEQ ID NO: 159) |
| S755 (FIG. 12) | S487 | CBDA Synthase Y175F: SEQ ID NO: 162 (SEQ ID NO: 161) |
| S756 (FIG. 12) | S487 | CBDA Synthase C180A: SEQ ID NO: 164 (SEQ ID NO: 163) |
| S757 (FIG. 12) | S487 | CBDA Synthase A181V: SEQ ID NO: 166 (SEQ ID NO: 165) |
| S758 (FIG. 12) | S487 | CBDA Synthase N196Q: SEQ ID NO: 168 (SEQ ID NO: 167) |
| S759 (FIG. 12) | S487 | CBDA Synthase N196T: SEQ ID NO: 170 (SEQ ID NO: 169) |
| S760 (FIG. 12) | S487 | CBDA Synthase N196V: SEQ ID NO: 172 (SEQ ID NO: 171) |
| S761 (FIG. 12) | S487 | CBDA Synthase H208T: SEQ ID NO: 174 (SEQ ID NO: 173) |

TABLE 5-continued

| Constructs and strains used in the Examples | | |
|---|---|---|
| Strain (Constructs) | Parent Strain* | Polypeptide SEQ ID NOs (Nucleotide SEQ ID NOs) |
| S762 (FIG. 12) | S487 | CBDA Synthase A235P: SEQ ID NO: 176 (SEQ ID NO: 175) |
| S763 (FIG. 12) | S487 | CBDA Synthase A250T: SEQ ID NO: 178 (SEQ ID NO: 177) |
| S764 (FIG. 12) | S487 | CBDA Synthase M256V: SEQ ID NO: 180 (SEQ ID NO: 179) |
| S765 (FIG. 12) | S487 | CBDA Synthase K260C: SEQ ID NO: 182 (SEQ ID NO: 181) |
| S766 (FIG. 12) | S487 | CBDA Synthase K260W: SEQ ID NO: 184 (SEQ ID NO: 183) |
| S767 (FIG. 12) | S487 | CBDA Synthase L268I: SEQ ID NO: 186 (SEQ ID NO: 185) |
| S768 (FIG. 12) | S487 | CBDA Synthase H309V: SEQ ID NO: 188 (SEQ ID NO: 187) |
| S769 (FIG. 12) | S487 | CBDA Synthase T310A: SEQ ID NO: 190 (SEQ ID NO: 189) |
| S770 (FIG. 12) | S487 | CBDA Synthase T310C: SEQ ID NO: 192 (SEQ ID NO: 191) |
| S771 (FIG. 12) | S487 | CBDA Synthase F316Y: SEQ ID NO: 194 (SEQ ID NO: 193) |
| S772 (FIG. 12) | S487 | CBDA Synthase L326I: SEQ ID NO: 196 (SEQ ID NO: 195) |
| S773 (FIG. 12) | S487 | CBDA Synthase G378T: SEQ ID NO: 198 (SEQ ID NO: 197) |
| S774 (FIG. 12) | S487 | CBDA Synthase G378S: SEQ ID NO: 200 (SEQ ID NO: 199) |
| S775 (FIG. 12) | S487 | CBDA Synthase K389E: SEQ ID NO: 202 (SEQ ID NO: 201) |
| S776 (FIG. 12) | S487 | CBDA Synthase E406K: SEQ ID NO: 204 (SEQ ID NO: 203) |
| S777 (FIG. 12) | S487 | CBDA Synthase S428L: SEQ ID NO: 206 (SEQ ID NO: 205) |
| S778 (FIG. 12) | S487 | CBDA Synthase L439M: SEQ ID NO: 208 (SEQ ID NO: 207) |
| S779 (FIG. 12) | S487 | CBDA Synthase N466D: SEQ ID NO: 210 (SEQ ID NO: 209) |
| S780 (FIG. 12) | S487 | CBDA Synthase K474S: SEQ ID NO: 212 (SEQ ID NO: 211) |
| S781 (FIG. 12) | S487 | CBDA Synthase Y499M: SEQ ID NO: 214 (SEQ ID NO: 213) |
| S782 (FIG. 12) | S487 | CBDA Synthase Y499V: SEQ ID NO: 216 (SEQ ID NO: 215) |
| S783 (FIG. 12) | S487 | CBDA Synthase N527E: SEQ ID NO: 218 (SEQ ID NO: 217) |
| S784 (FIG. 12) | S487 | CBDA Synthase P538T: SEQ ID NO: 220 (SEQ ID NO: 219) |
| S785 (FIG. 12) | S487 | CBDA Synthase R541E: SEQ ID NO: 222 (SEQ ID NO: 221) |
| S786 (FIG. 12) | S487 | CBDA Synthase R541V: SEQ ID NO: 224 (SEQ ID NO: 223) |
| S787 (FIG. 12) | S487 | CBDA Synthase H542V: SEQ ID NO: 226 (SEQ ID NO: 225) |
| S788 (FIG. 12) | S487 | CBDA Synthase R543A: SEQ ID NO: 228 (SEQ ID NO: 227) |
| S789 (FIG. 12) | S487 | CBDA Synthase R543E: SEQ ID NO: 230 (SEQ ID NO: 229) |
| S790 (FIG. 12) | S487 | CBDA Synthase H544E: SEQ ID NO: 232 (SEQ ID NO: 231) |
| S791 (FIG. 12) | S487 | CBDA Synthase H544D: SEQ ID NO: 234 (SEQ ID NO: 233) |
| S935 (FIG. 12) | S487 | CBDA Synthase I445M: SEQ ID NO: 300 (SEQ ID NO: 299) |
| S938 (FIG. 12) | S487 | CBDA Synthase M412Q: SEQ ID NO: 302 (SEQ ID NO: 301) |
| S940 (FIG. 12) | S487 | CBDA Synthase L415M: SEQ ID NO: 304 (SEQ ID NO: 303) |
| S941 (FIG. 12) | S487 | CBDA Synthase D115N: SEQ ID NO: 306 (SEQ ID NO: 305) |
| S942 (FIG. 12) | S487 | CBDA Synthase A414T: SEQ ID NO: 308 (SEQ ID NO: 307) |
| S943 (FIG. 12) | S487 | CBDA Synthase A414T: SEQ ID NO: 308 (SEQ ID NO: 307) |
| S944 (FIG. 12) | S487 | CBDA Synthase A414V: SEQ ID NO: 310 (SEQ ID NO: 309) |

TABLE 5-continued

Constructs and strains used in the Examples

| Strain (Constructs) | Parent Strain* | Polypeptide SEQ ID NOs (Nucleotide SEQ ID NOs) |
|---|---|---|
| S945 (FIG. 12) | S487 | CBDA Synthase A414M: SEQ ID NO: 312 (SEQ ID NO: 311) |
| S946 (FIG. 12) | S487 | CBDA Synthase A414M: SEQ ID NO: 312 (SEQ ID NO: 311) |
| S1100 (FIG. 11) | S510 | CBDASco5: SEQ ID NO: 3 (SEQ ID NO: 2) |
| S1101 (FIG. 12) | S510 | CBDA Synthase R31Q: SEQ ID NO: 60 (SEQ ID NO: 59) |
| S1102 (FIG. 12) | S510 | CBDA Synthase L49E: SEQ ID NO: 66 (SEQ ID NO: 65) |
| S1103 (FIG. 12) | S510 | CBDA Synthase L71H: SEQ ID NO: 104 (SEQ ID NO: 103) |
| S1104 (FIG. 12) | S510 | CBDA Synthase M61H: SEQ ID NO: 88 (SEQ ID NO: 87) |
| S1105 (FIG. 12) | S510 | CBDA Synthase M61W: SEQ ID NO: 92 (SEQ ID NO: 91) |
| S1106 (FIG. 12) | S510 | CBDA Synthase L132M: SEQ ID NO: 136 (SEQ ID NO: 135) |
| S1107 (FIG. 12) | S510 | CBDA Synthase V149I: SEQ ID NO: 142 (SEQ ID NO: 141) |
| S1108 (FIG. 12) | S510 | CBDA Synthase S170T: SEQ ID NO: 156 (SEQ ID NO: 155) |
| S1109 (FIG. 12) | S510 | CBDA Synthase L171I: SEQ ID NO: 158 (SEQ ID NO: 157) |
| S1110 (FIG. 12) | S510 | CBDA Synthase Y175F: SEQ ID NO: 162 (SEQ ID NO: 161) |
| S1111 (FIG. 12) | S510 | CBDA Synthase N196Q: SEQ ID NO: 168 (SEQ ID NO: 167) |
| S1112 (FIG. 12) | S510 | CBDA Synthase N196T: SEQ ID NO: 170 (SEQ ID NO: 169) |
| S1113 (FIG. 12) | S510 | CBDA Synthase N196V: SEQ ID NO: 172 (SEQ ID NO: 171) |
| S1114 (FIG. 12) | S510 | CBDA Synthase H208T: SEQ ID NO: 174 (SEQ ID NO: 173) |
| S1115 (FIG. 12) | S510 | CBDA Synthase K260W: SEQ ID NO: 184 (SEQ ID NO: 183) |
| S1116 (FIG. 12) | S510 | CBDA Synthase L268I: SEQ ID NO: 186 (SEQ ID NO: 185) |
| S1117 (FIG. 12) | S510 | CBDA Synthase F316Y: SEQ ID NO: 194 (SEQ ID NO: 193) |
| S1118 (FIG. 12) | S510 | CBDA Synthase G378T: SEQ ID NO: 198 (SEQ ID NO: 197) |
| S1119 (FIG. 12) | S510 | CBDA Synthase N527E: SEQ ID NO: 218 (SEQ ID NO: 217) |
| S1120 (FIG. 12) | S510 | CBDA Synthase R543E: SEQ ID NO: 230 (SEQ ID NO: 229) |
| S1205 (FIG. 12) | S487 | CBDA Synthase M61W, G378T: SEQ ID NO: 314 (SEQ ID NO: 313) |
| S1206 (FIG. 12) | S487 | CBDA Synthase M61W, K389E: SEQ ID NO: 316 (SEQ ID NO: 315) |
| S1207 (FIG. 12) | S487 | CBDA Synthase G378T, K389E: SEQ ID NO: 318 (SEQ ID NO: 317) |
| S1208 (FIG. 12) | S487 | CBDA Synthase M61W, G378T, K389E: SEQ ID NO: 320 (SEQ ID NO: 319) |

*If a strain has a parent strain, it is a child strain. All of the constructs present in the parent strain are also all present in the child strain.

**S4 is CEN.PK113-1A with genotype MATalpha; URA3; TRP1; LEU2; HIS3; MAL2-8C; SUC2

*** S478 is the competition assay base strain used to test the library of CBDA synthase constructs. In this strain, the nucleotide sequence encoding a pGAL1_tTDH1 empty expression cassette is added and the CBDA synthase polypeptide in parent S270 is deleted, creating a strain without synthase. A THCA synthase is added at a second locus.

**** S487 and S510 are the non-competition assay base strains used to test CBDA synthase constructs selected by competition assay result. S487 has extensive chaperone and secretory pathway engineering while S510 has a more minimal set of engineering. In these strains, the nucleotide sequence encoding a pGAL1_tTDH1 empty expression cassette is added and the CBDA synthase polypeptide in parent S270 is deleted, creating a strain without synthase. There is no THCA synthase.

TABLE 6

List of Regulatory and Other Elements

| SEQ ID and Type | Name | Sequence |
|---|---|---|
| SEQ ID NO: 235 Flanking homology | ui1 | GCTTGTACTGAAATTAACGAGAAGATTGCTTTGTCGAGACGTATCGAAAA<br>GCATTGGCGTTTGATTGGTTGGGCAACCATTAAAAAGGGTACTACATTGGA<br>ACCCATCGCTTAAGGAACCAATAAAACCACTGCAAAGACAAAAATTTCAT<br>AATTAATCTGAAAGAAAGTGAAGATAAGAAACGGGCTAGGAGGAAGGGA<br>AACTGACACTTCTGGTTATTGCAATATGCTCATATACATTGATGCGTAATG<br>ACATTGATGATCTTTATTCTCTTTTTATAACGTTTTCTTTCTTTTTTTTTCCTT<br>CTTACATAGTATTCAACTGTATATTTAACATGTTTTACGTATTTTTAAGAAA<br>AAATTACTAAACGCGATAATATTAAGCAAATATTTATCTCATAGTTCTCGA<br>ACTCATTTATTTCCCATTGATGCCATGAAAACCTCTCAAACCTTTATCGTCT<br>AGTTACACCAGTAGTCAATAAACTGCCTTTCTTTTTTTAC |
| SEQ ID NO: 236 Flanking homology | di1 | ACAATTGCACAAAGATAATGAAGCTCCAAAATTATTCAGTATCTATTGAGT<br>ATATATAACCTTGAAAAGGTTTTATTTTATATAAGTTCGCCATCTTAGTATA<br>GTGGTTAGTACACATCGTTGTGGCCGATGAAACCCTGGTTCGATTCTAGGA<br>GATGGCATATTTATTTTTTATATTCTTAATATACAAAGAATGTCGTGTGAA<br>GCTGTAGGCACAGGTAATTTTGTAACCATAGTCAGATGTGGTGATCATGAG<br>AGCGAATTATAATTTTATACCAGCTGGCAAGAATTGAGTAATATTTAGACC<br>AGCATATAAAAGTAGAATAAAAAGTTATATGTACAAATTTTTTTTGACGCC<br>AGGCATGAACAAAAACTACTATGGCTTTGGAATTTTCAAGCTCTTCGAAAT<br>CATTCCACACCCATGGATAAAAAATACTAGAATAATTGGATGAAATTCCA<br>ATATTTGGTCTTCTCTAAAAATGCCGAATGGGATGTTATCA |
| SEQ ID NO: 237 Flanking homology | ui2 | AGTTTTGCCGCTTTGCTTGATCACTGTTAGTATTTCGGCAAATTATATGGTA<br>TTGGTCGCCTTGCCAGGTTCTTTAGGAAGTTCATCATAAACTAACGCTTTC<br>AAGAATTTACGGAAATGATAGGGTTTATAGTTTTTATAACAGTAGTGGACC<br>TAGAAAACACCGATAGCTGGCGGCGGTTATATCTCATTACTACTATGAAAA<br>CTGTGGCTCCTGAGTAGCTACTGAAGGATGTGCCCATCTTAATCCAGACCT<br>AGTCAATACAATCAATACAACTGTCTAGCTGAAAACTGACAAAAAAGTTT<br>GTCGATGTCTCTAGTATATTCACTATAACACTAAATTTTATTGTAAATTATT<br>ACACAAGTTTTCAAGAAGAAAAACAATATTAAACACAATAACTAGATTAT |

TABLE 6-continued

List of Regulatory and Other Elements

| SEQ ID and Type | Name | Sequence |
|---|---|---|
| | | GCGAGGCACGGCAAAAGGAGTGAAGAGGGCAAAATACGGAGAAGACAAT<br>ATAGAATAAATTTCTTTTTTTGATTAGAGAAGATTGTTTGCCA |
| SEQ ID NO: 238 Flanking homology | di2 | ATAGTCTTACCATGATGATCAGTCGGATTCTGACGACGTTGGGTATTTTAA<br>AACACGCGTAATTGAAAGGGTGATGTTGAGAATGGACCACTTCAAGATAT<br>GCTCGAAAATGTAGCTATATTTCACGGATGAATAACTCGTAAGAATGTGCA<br>GTAGCTGATGGACCTAGGAACGATCAAGTCAACGTTGTATTTTGGTTCGGC<br>AAACAATTGATATGATGTTGACAAGAAAACCATCTGCGCTCTAATCTCTAA<br>GTACACGTGCATTTGGACCTATCATCAAAAGAGAATAAGAGGATACTTTC<br>AAGAGAAGTTCAAAAAAGAATCATTATTATGATCCAATGACAGTGACAAT<br>AAGATCAACATAAAAAAGAAAAGTCAGAAGTATAAATCTGGGTCTTTTTC<br>TCTAAAATAATTATAGTCTGTTAATTTATAAAACTGCCTAAAAAATATACT<br>TAAAATATGTCTACAGATTATGCAGCTGGAAAAAATCAAGCAAAA |
| SEQ ID NO: 239 Flanking homology | ui3 | CCAGTTATCCTAGGCAATTACTTTATTTGAGTCTTATATGACGTCACTAGA<br>AGCTCAGTAAGAGCAACCGAGACCTGAACATCCTTTTTTTTTTTTGCTTCTT<br>TATTTGGCAGCATTTTTCAAAAATAATAAAATGGAAGCCGCGAGTACGAA<br>CAATGATGTGTTCTGGGAATACCTCGTCAAAACAAGACAATGGTAAGGAT<br>TTTCTTTCATCAGGCAGAAAGATCTGGATCTGAATGGCATCATTTTGTGAT<br>GTGTAAAAGCGGGACCTTGTTATTTCGACTTTTTGCATCATGTTGATGCAA<br>TTTGCTACTTTTCCGACGGTGCGCTCCAACGGATGGGTATTTCCTTAATAAC<br>AAGGCATTTCTCTGGAAGTTGGCTTACTGTTTGAAATCACAGCCGGTCACA<br>AAATAAAGTAAAAAAACTATCTCTCTCCACAAGAAGTAATTACAGGTTGT<br>ATACTACGTGTGATCGTATTTCTTTATGAACACTAAGGAGTT |
| SEQ ID NO: 240 Flanking homology | di3 | CGTGTCTGAAAAATCTTGAATTTTCAGAAAAGAATAAGCCCCAAATGTCA<br>GTGATGGTAGTAGCAGTACTCCCCTACGATTTTAGATACTTTAGAGAGCCC<br>ACCTTCAGAATCGGAAGGAGGATAATTTTGTAAAGCCCTTCTGTTTTTTCT<br>CTTGCATAACTTATATTTCCACATCAAAAAGTAGTGTGCTAAGAAAAAGGA<br>GACGAGAAAAAGGATTACGGCACTCTCTGCATCTAGACATATACCAAAAG<br>TTGGGTTTGCTCACGAAAATACCATAATTGTGGTGTCAAAAAAATCCTGCC<br>TCATAATACCACTGCAGCAATTGTGGATGACTAAAAAATAACTTGCATTCC<br>ACGATGTTATTTTACTTTATAAAGCACCTGCAATTTTTTTTTTGTATTAAC<br>TCATCGAGTATGTCTGATGTGTAAACTGAACCAGGCTTAATATCGTTTCTA<br>ATTCTTGTTGTGAGAAAACTTTCCTGCCTAATGTATTTCGTC |
| SEQ ID NO: 241 Flanking homology | ui7 | TAAAATTTTACTCATAGTAGATAATGGCATAAATCAGTGGTAAAAAAAGA<br>ATACGCATGACAAATTTTGAAAACCGTACGTGACATAAAATACCTATAAT<br>AAGATGAAGACATCAATTCTCAAGTTCCACTTTTCGCCGGTTGAGTGTATC<br>GGTCATAGTACAAAGGCAGAAATGAATAATAGTAATATTAATCGCAGTTT<br>CCTGTTGTTTAGAGAACTGAAACGCTTTGTGGGCATCAGGTTTAGATTAAC<br>TGCTACCCTTCTTCTGTATTTGTCTGGCCATGCTTCTCAAATAAACCGCTGC<br>GGATAACATTTCAAGTGGTTTCTCAAGGGAGAATCATAGTTTAGCTTAACA<br>TACAGCAAATCGTCACTATCTTGACTGATGCCCGGTGTATAGAGAATGGGT<br>AGTTAATATCATCTAGATGGGGTTTCTTTGAAAACACCAGTTTCTTTGAGG<br>ACACCAGTTTCAGTGCTTCTCTCTACCCCATCAACTATTGCAC |
| SEQ ID NO: 242 Flanking homology | di7 | CGTCTTGCTTTTTTCGGTAGTTTTTCGTTTCGATAAAGGCAACAATGCTGTA<br>TATTGTATGCAGGAAGTTCTTAAGGAAAATACAGGAATCTTTAGAAAAAG<br>AATAAATAGCTTTCCATTGTATCATGAACAAGTCACTCTTCATATTATATGT<br>CGTCGCTTCTTATCCCTTTAAGTTATGAATTGTTGAGCTTAGGATTTTACCA<br>CAACTGAATAACATTTTCTTTATTCTAATAATCGATTTTTTTTAATAAGATT<br>AGACTTGAGTGCCATCAGCAAAGAAAAATACTTTTAATGTCCTTTTTTTAA<br>CTCTACACAGAATTTAGTTGGCTGTTTCATTGATTTACAAAAATATAAATA<br>TATACCGTTAAAATTATAGCGATAAACTGAGTATGTGGTCTCTCTTTTCCC<br>GCAGAATATGAAAGCTTTTCTTTTATAAATCTTATAATATTGGTCTCTTTTT<br>GGTACGTTTGGCAAATTGGCATTCATTTATCATGAAA |
| SEQ ID NO: 243 Flanking homology | ui10 | AGGACCACTTCATCAAGTTTCGAAAGTGAAATTAAATCCATTTCAGAAAAT<br>TTCAAGAACTCTATTCCAGAATCTTCCATACTCTTCAGGATATCATATAAT<br>AACAACTCTAATAATACCTCTAGTAGCGAGATCTTCACACTTTTGGTAGAA<br>AAAGTTTGGAATTTTGACGACTTGATAATGGCGATCAATTCTAAAATTTCG<br>AATACACATAATAACAACATTTCACCAATCACCAAGATCAAATATCAGGA<br>CGAAGATGGGGATTTTGTTGTGTTAGGTAGCGATGAAGATTGGAATGTTGC<br>TAAAGAAATGTTGGCGGAAAACAATGAGAAATTCTTGAACATTCGTCTGT<br>ATTGATAAATAAAACTAGTATACAGCAAATACTAAATAATTCAAGAAAAA<br>AACATTAGATAGAGAGGGGCAGATGTTCAAGCTATACCCATTATATTGATC<br>CACACTTAGTATTAAGATACGTCTGTGAAGGATGAAAAAAAATGTAT |
| SEQ ID NO: 244 Flanking homology | di10 | TTGTGCGTTTTTATAATTTTTTTTTTTTTGTAATTCTATGCAAATGTAATATA<br>AGTATATTTAAAGAAATAATGAGTCCTGTGAAAACAAAAAGAAAAAAAGA<br>TCATTAATGTATGTTAACGTATTTGCTTTGCAAATTTTAATTTATTTGTTGTT<br>AAATGCATTTTTTTTTTGTCGTTTCAGCGAGTTTTCTTGAGGTTGCTACTAT<br>CATTAAAATCACAATCCACAGAGGAAGTTGATCTCTTTTTCAGTTGGGTGG<br>GGGCAGAGCATGGGTGAGCAGTGGCCATGGGTCTAACAGGAAATAATCTT |

TABLE 6-continued

List of Regulatory and Other Elements

| SEQ ID and Type | Name | Sequence |
|---|---|---|
| | | TTTGAACGCACAGATAAATTTTGTAATAATTTTCTATTTGACATTAGAGAT GGGGTGGTGGGAGTTAGTGGGCTTGGCCAAAAGATGCTTGAATTTTGTGG GATGCTCAGTGACCTTTTAAAAGAATTTTGGGTAGAAGAGAACGAACCTG AATGTGAATGGTGTGATGCAGAGTC |
| SEQ ID NO: 245 Flanking homology | ui21 | CCATCTATCCTTCGCCTCTCCTTCGCTCTGTAATTTTTTTTACTCGCGCGCTT CCGACTTTTGAAAGAAGGAGCAATAAAGTTAAATAAATGTAATTAAATTA TGCTTTTTTAGGCAAGTTCGGGACTTTGTTGCCACGTATTGCTCTTCTATGC AAGCACTTCACTCCTTTTCTTTCATCTCTGTTTTCTTCCACTGGCTGGAAGC TTGAGGGTTGCCTCTTGATTCTTTATCGCCTGCAACCATTGCCTTGTTCCGT CCTCTCAAGGCGTTCCTTCCGTGCTTTTTAAATACTAGAATCATTCGAGAC GTATTTATGAGCATGTTACTTCTTGATGTTTATCTAAGAGGGTTGTTTAGGT TATCCGCATTATTTTTAAAGTTTTAAGGTTACATCATTTATTCAGACGCGTT CGGAGGAGAGTGCATTCACCAAGATGTAAATTTCTTCAGTTTTCCGGATTA GGATTGGAAAAATGAAGAAAAATAG |
| SEQ ID NO: 246 Flanking homology | di21 | CTAAAGTAATTGTAGCAGTTGTTATTAAGGAGTTCTTTAAATCATATTGCTT GCTTGTATCAGACCATTGGAAACTTCAATGTTTAAACTCTAGAAAGGTTGA TCTGCTCAAATATTTTCATATTTACGGCATGTCCTAACTTGAACATTTGTAG AAGAGAGACATATTTCTTAGTGTAGGCAAGATATTTGAATGACATTGTCTG CCGAAATATACTCGACTTGCAGTGGAACTGCAAGTCGAAAAGGATATCGC TTTAGCCAAACAAAAATTTGTTGTGCTATTCAGTGAGCATGCATTGGCTAT AGAGGCCGCACCTAAATTGTATCTTTTGATTTATGTAACTGCCACACTTTCT CTAGCACAGTCATGATACGGCTTTTTTTCATTTAGCCACCAAATACTGTAA ATATCGTTTTAGAACGTTATGAAAAAATGCTCATCCACTTAAAAACCTCTC CGTATTCTGAAAGTTGGTATAATCTTGCACTTTAAGTGT |
| SEQ ID NO: 247 Flanking homology | ui33 | TCTGTTAACCATTCTGGTTCACTTGCCGTCGTATGTTGCGGACCACCTATTT TCGTCGACACCGCTAGAAATCAAACTGCCAAAGCTGTTATCAGAAACCCA TCAAGAATGATTGAATACTTGGAGGAATACCAAGCCTGGTGAACAATTTTT CATATTTAAGTAAACACTCAATGTATAATATCCTCTAACTGTTGTAATTTCA TTAACGTAAATGGTTTGCGCCTTTTTTAGGGGACCCTTGTTGATTCATTCTA ACTACTGAGGCATAAGTTGTTTCAAATAACACTTTTTCAGAAAAATAATCG TATTAAAAAGCAGAAAAATCATACGTAAGATGACAGAAGCTTCATATTTA GTAACTCTGAATTGTATAACACACCAATTGCCGATAGAATATGAACCAATC GATCTTCAGCGTTCATGTACTTAATTTAACTACCTGTATTTTCTTATAAAGA TAAAATTGGTGTATAATGTAAGGGCCAAGAGAAAAAGGAATC |
| SEQ ID NO: 248 Flanking homology | di33 | ATTTCTTCAAAAAAATAACTGAATAAACACCTATATAATGTTCAGAGGTTA TACTTTAGTGTTTTAGAATGCAGTACCAAAAGTAATATATTGAATTAATAA CTATATGATGTGTAGCTAAGAATTAAATAGTAAACGTCTTCTGAAACCTTT TAAGAGGTAATTATTGGTATTCCAAAGTCATATGTGGAGGTAAGGGAGAC ACAAAATTATCTGGAATGACAGCGTGCTGACACATATAAAGTTCCGTAACT TCAAATGCCTTCATTATTCAACATAGGAAAAGTGAAATGTGTGCCTCTAAA ATATACGGAACATCGTCGAACTAAAAAAATCCATTAAGCAAAGTTAGAAA CAGCATGCACTACAAGACATTTGGTTCATCATGAAGAATGCTCAATTGAAC CATCAATCACTTTCTCTTGTTCGATGTTAGCATTATCCTCACTATCAGTTGA ATCCTCAATGCTTTCGGTTTCAGTCCTCGCATCTTC |
| SEQ ID NO: 249 Flanking homology | ui34 | TGAGCAACCAATCACTTCTGAAACCGCTATGAAGAAGGTTGAAGATGGTA ACATTTTGGTTTTCCAAGTTTCCATGAAAGCTAACAAATACCAAATCAAGA AGGCCGTCAAGGAATTATACGAAGTTGACGTATTGAAGGTTAACACTTTG GTTAGACCAAACGGTACCAAGAAGGCTTACGTTAGATTGACTGCTGACTA CGATGCTTTGGACATTGCTAACAGAATCGGTTACATTTAATCTAATTGGTT TAATTAATAAATTTAATATTATTTTTAAATTTTTCTTTAAATATACAATAAA TCTTTCATAACATGTTAAATTCATGATTAAGCGTAAATAAAGTGTAGTGGC AGAGTGCACGGGGTTTCCTGTGCCTTACAAAGTAGGTACCAATTTGCGTAT TGCAGCGAGGGTTCCGGTTACTATTTATAATTACGTGTTAGTGTACTGTGA TTTTATTGAGGCTATAACAAGAAAAGGATCTGTGAAGGTTTTGAG |
| SEQ ID NO: 250 Flanking homology | di34 | CCCTTTTCTTTTCGCAAGATGAGAGTAAAGAGTTGTACATCAGGTAAGAAT GTTATTATTTAAATTCGAAGTGATAAATTCTTTTCATGATGAATCACTCGCT TATATGGGGTAGAATATATATATATATGTGTGTGTGTGTGTGTGTTTGTGTAT GTAGGGATGGTGCGCGTTTGTTGTGTGACATTTGCTACTCATTCTTTTCCTT TTCCTACGACTGGCTTAACGGGAATATTATCAATTTGCTGCATTCTTATGCT TCGGTCCGATGCTCATTAAGATGATGCAGATCTCGATGCAACGAATTCCAA GCCCTTATCGATATTTTTCTTTAACTGGGAGACGCAAATTGGCAACATTTG GTTGCGTTCCATGTCGTTCATCCTATTAACGATGTCATAATCCACATAGGA AACACCCTTTGTAGTAATAGTTAATGGTATGGCAAAGTAGTCTGCACCGTC CACCAGAGGCAATAATTGATCTGCCCCAGG |
| SEQ ID NO: 251 Flanking homology | ui1001 | ATGAGTTAACGTAGATTACTTTCCGTTAGTGTAACGGACAAGATGACACAG TATTGAAACGCTCCTCTATCTTTGTGGGTGTTGAGGGAGGAGAGAGTTATT AGTCTAGACGCTATATATCACAGAGTCGAGTGCCCAATAATATAGCAGGT AGACGCCAACTTAACTACTGGATGTGAGTTAGAGAGGAATATACTGTTTTA |

TABLE 6-continued

List of Regulatory and Other Elements

| SEQ ID and Type | Name | Sequence |
|---|---|---|
| | | TTAACTCGTACCGTAGTGGTTTCTGGCGAGAATTCGCCGGCTTAAAATCTA TTGACTAACTAGAATTAGCTTAAAGTGGACCTTATTGAATCTCACCGGGTT ATCGCGACATTTATATTATCGAAGGGTCCAGCTTGGGGTTTGTTTGGAAGG TTGACTTGTTGTTGTAGTTGTATCACTAATAATTACGATTCTCAACGACCGG CCCAAAGATTGCCTGGGTTAAATTCAGCGTCTGATGTATACTTAGCTCTTC GCAAGTAGTGTTCTAATTAAAGATCACTTCAACTTATCTTC |
| SEQ ID NO: 252 Flanking homology | di1001 | AAGGTAACTTAGGCTGACGACGCAATAATGCACGCTCGCGTGTGATGAGA TTACATCAGTAAGAATTCATATCTCGATATGGGATAATTACGGGCTCACAC TCTAGGAATACCAAGAACAGTAATGTTTCCTTATTAATATGTAGATAAGGA TCTTCTTAAAGTTTAATTGATGGCGAATTCCAAATAGTGACTTAACTTTCGC GCAGAGTATCGCAGGACAAGGTTAGCTTTTCGTAAGCCTGATGTTATGCCA TAACTAGCCACCTTGTAATCCCCGCGCTCAGTAAATCTATCTACTTATTTGC TTCACTTCTTCACGGAGAGTACTGATTTTCTTCTCTCAATACTACTGACTAC CTTAGGGCGACATACTTTAGTTCTGCATAAGCGTCAACCTCTTGCCTAAGG GTATGGATCCTTGTTAAGCCTTATTCCATATAGTTGAGCTGAAGAACAGAT CCCTCAACTCGAGTGCGACTAGTAGCTAGTTACGAACAC |
| SEQ ID NO: 253 Flanking homology | uPEP4 | TGTTAATCCGTTTTCAATATCTTGAGCTCCTCAATTGTATTTGCTGAGGTCT GATTATTTCTATAACCAAAAGCGGTTATTGAATCTATGGAGAGGCTGTAAC CCGTCTTATGCCTTCCGGGTACTATATTTCATTTGCGGGTGTCGATGGATTA AGGGGCGGAGGCGGCCCTTTTTAGGATTTATATAAAAAGCCATACTTCCGT ACTTCGTAACCTCTTATCAACTGGTTAAGGGAACAGAGTAAAGAAGTTTGG GTAATTCGCTGCTATTTATTCATTCCACCTTCTTCTTTTTTGAGCGAAGCCT TTATAATCAAATTTTAGTGGTCTTTTCTATTTTTATTTGAGAAGCCTACCAC GTAAGGGAAGAATAACAAAAAGTATATCTCACCCTACTGTATTCATAAAA AGTTTTTTCTATTAGAATTCTATAAGAAAAGAAAAAAAAAAAGCCTAGTG ACCTAGTATTTAATCCAAATAAAATTCAAACAAAAACCAAAACTAAC |
| SEQ ID NO: 254 Flanking homology | dPEP4 | GCTAAACTTTTCTTACTTCTCCGCCCTATCCTTTTCTGCCATCTAGAGAGCT TTTATAAGTAGATAACAATAAAAAAAACTATAGTATATTTAAAAAAAAAA AACAAGACAAACCATCTTGTCCTCAGTTTTAGAATCCATTGTTCTATGCTG CTGCCCATAATGTCATTATATGCGGGTAGCCCGATGATGCGGCTCGAGAAT TTCCTTGTTTATCCTTTTCCAATAGCGGAACAATTGATAATAAAGCAATGT AAGCAGAAGCGAAAAATAAAAAGAAATAGGCTGCAGAGATTCACAGGCT GCGCTCTAGAAACATTTGAAATCAAGGCAAACATAGAACACTTGATAAAA TTCTTACCATAATACCACCATTGATGATTCAAAAAATGAGCCCAAGCTTAA GGAGGCCATCAACGAGGTCTAGTTCTGGTTCAAGTAATATCCCACAATCGC CCTCTGTACGATCAACTTCATCGTTTTCTAATCTGACAAGAAACTCCATAC GG |
| SEQ ID NO: 255 Flanking homology | uROT2 | GCTGCATTCTTCAGTGGTATGTTATTTATGTAACGGGTATGCGAACCACAA CGCCAGATTCTTGAAGGGGAAACCTAACTACACAGTCTTAGCAACAACCG CCGGCGCTCTGGGTCTTTTGACGCTGGACGGTATAATTTCAAAGAAATACT ACTCCAGATACGACAAGAAATAATAACATACTATTTAATAACATCCTTTTC ACACACTCACACACTCACATACTTATATACATATATTTTTATAACTATTAC TGCTGATTTATTTGTAAGGAAACGTGCTTTCCTCTTCATCGGTCAAGTGATA AGTTTCTATAATATAATAGCTTTTCTGTCTACTATCATTCTTTTTTCATTTCA AGTACCCTTAATTTGTTTTACCCGGACCACGAAATTTTCTCACTACGGCACT TGAGAGCTATAACTCAATGAACATGTTGCTTGGAGTGATTTGATTGCTCTG CGTATCTTAAAATAGCGGTCTCGAATCAACCGTATGCAAC |
| SEQ ID NO: 256 Flanking homology | dROT2 | GGGAAAAAAACGAAGGGGTATCTTTACATCTTTTTAGCTCTTTCTTGCAAA TTAAACGTAAAAATATCCGTAAATATAACATATAACCATTATCTATAGAAA AAAAGAACCGAAAATTGTGTCAGGCCCTACTTCCCGTGAGCTAACTTCATT CTTGTCGAAAACTTGACTAGGGTCGTCCAGTCGCAAAACGTATCACATTTC GGACATTTCCCACCTCGAGGTATCAAGTTTCTTCTCCCTACTATCAACTGTT CATCATCTAGAAAGTACCTGTGAAGACATTTCAAGTGGTTAACAGACCCGC AGTCTTTATTATTGCAAAGCGCTACAAACGGCTTCAGATTTTGCTCTTCAG ACGTGTAGTCAATTTCTTTCTCACAAATTTCACATCGCACTACCCCTGTAGT TAGTTTCTTTTCGAAAGTTTCGAATATGTTTCTTTCATTTTCAATGACTTTA GTGTATACAGCTTCTACCACTTTTAAATTCTCATCAC |
| SEQ ID NO: 257 Linker | D0 | ATCGACGGGCCGGCCAGTGTCTCTCGTTTAAACTTG |
| SEQ ID NO: 258 Linker | D2 | ATGAGTATGCTATACTCCCACTAATGGCATCACGCT |
| SEQ ID NO: 259 Linker | D3 | TAGGCAAGAATAGCGGAGCACTAGGTTTCGACTTAA |

TABLE 6-continued

| List of Regulatory and Other Elements | | |
|---|---|---|
| SEQ ID and Type | Name | Sequence |
| SEQ ID NO: 260 Linker | D4 | ACGATCCACGGCTTCTAAAGACTGACAATTGCTTTC |
| SEQ ID NO: 261 Linker | D9 | CAAAGCTAGGCCGGCCCTTAGTACTAGTTTAAACCG |
| SEQ ID NO: 262 Linker | D20 | TCGGAGCAAATGAAACGATTCCGATAAGTGTTGCAA |
| SEQ ID NO: 263 Linker | D21 | TTGTGGGTGAAAGAAGGAGAGGTACGTTTCTATCGT |
| SEQ ID NO: 264 Linker | D22 | AGACAGACCCGCCTTAATCTACAAGATTCGTGACAT |
| SEQ ID NO: 265 Linker | D23 | CATTATATTTCCTACGGAGTCGGAAGCAGGGACGTA |
| SEQ ID NO: 266 Linker | D30 | GGACCACCAGTAACACTCCAATTCTGGGTGATTTAC |
| SEQ ID NO: 267 Linker | DH7 | CTCTTATTACCCTATCCTATGGTACTTTCTCGGCAG |
| SEQ ID NO: 268 Linker | G1 | ACCTCTATACTTTAACGTCAAGGAGAAAAAACTATA |
| SEQ ID NO: 269 Linker | G7 | CATGATAAAAAAAAACAGTTGAATATTCCCTCAAAA |
| SEQ ID NO: 270 Linker | G10 | AAAAAAAAAGTAAGAATTTTTGAAAATTCAATATAA |
| SEQ ID NO: 271 Linker | RG1 | TATAGTTTTTTCTCCTTGACGTTAAAGTATAGAGGT |
| SEQ ID NO: 272 Linker | LTTDH1 | ATAAAGCAATCTTGATGAGGATAATGATTTTTTTTT |
| SEQ ID NO: 273 Promoter | pGAL1 | TTTGGATGGACGCAAAGAAGTTTAATAATCATATTACATGGCAATACCACC<br>ATATACATATCCATATCTAATCTTACTTATATGTTGTGGAAATGTAAAGAG<br>CCCCATTATCTTAGCCTAAAAAAACCTTCTCTTTGGAACTTTCAGTAATAC<br>GCTTAACTGCTCATTGCTATATTGAAGTACGGATTAGAAGCCGCCGAGCGG<br>GCGACAGCCCTCCGACGGAAGACTCTCCTCCGTGCGTCCTGGTCTTCACCG<br>GTCGCGTTCCTGAAACGCAGATGTGCCTCGCGCCGCACTGCTCCGAACAAT<br>AAAGATTCTACAATACTAGCTTTTATGGTTATGAAGAGGAAAAATTGGCA<br>GTAACCTGGCCCCACAAACCTTCAAATCAACGAATCAAATTAACAACCAT<br>AGGATAATAATGCGATTAGTTTTTTAGCCTTATTTCTGGGGTAATTAATCA<br>GCGAAGCGATGATTTTTGATCTATTAACAGATATATAAATGCAAAAGCTGC<br>ATAACCACTTTAACTAATACTTTCAACATTTTCGGTTTGTATTACTTCTTAT<br>TCAAATGTCATAAAAGTATCAACAAAAAATTGTTAATATACCTCTATACTT<br>TAACGTCAAGGAGAAAAAACTATA |
| SEQ ID NO: 274 Promoter | pGAL1-10 | TATAGTTTTTTCTCCTTGACGTTAAAGTATAGAGGTATATTAACAATTTTTT<br>GTTGATACTTTTATGACATTTGAATAAGAAGTAATACAAACCGAAAATGTT<br>GAAAGTATTAGTTAAAGTGGTTATGCAGCTTTTGCATTTATATATCTGTTA<br>ATAGATCAAAAATCATCGCTTCGCTGATTAATTACCCCAGAAATAAGGCTA<br>AAAAACTAATCGCATTATTATCCTATGGTTGTTAATTTGATTCGTTGATTTG<br>AAGGTTTGTGGGGCCAGGTTACTGCCAATTTTTCCTCTTCATAACCATAAA<br>AGCTAGTATTGTAGAATCTTTATTGTTCGGAGCAGTGCGGCGCGAGGCACA<br>TCTGCGTTTCAGGAACGCGACCGGTGAAGACCAGGACGCACGGAGGAGAG<br>TCTTCCGTCGGAGGGCTGTCGCCCGCTCGGCGGCTTCTAATCCGTACTTCA |

TABLE 6-continued

| List of Regulatory and Other Elements | | |
|---|---|---|
| SEQ ID and Type | Name | Sequence |
| | | ATATAGCAATGAGCAGTTAAGCGTATTACTGAAAGTTCCAAAGAGAAGGT<br>TTTTTTAGGCTAAGATAATGGGGCTCTTTACATTTCCACAACATATAAGTA<br>AGATTAGATATGGATATGTATATGGTGGTATTGCCATGTAATATGATTATT<br>AAACTTCTTTGCGTCCATCCAAAAAAAAAGTAAGAATTTTTGAAAATTCAA<br>TATAA |
| SEQ ID NO: 275 Promoter | pGAL7 | GGACGGTAGCAACAAGAATATAGCACGAGCCGCGAAGTTCATTTCGTTAC<br>TTTTGATATCGCTCACAACTATTGCGAAGCGCTTCAGTGAAAAAATCATAA<br>GGAAAAGTTGTAAATATTATTGGTAGTATTCGTTTGGTAAAGTAGAGGGG<br>GTAATTTTTCCCCTTTATTTTGTTCATACATTCTTAAATTGCTTTGCCTCTCC<br>TTTTGGAAAGCTATACTTCGGAGCACTGTTGAGCGAAGGCTCATTAGATAT<br>ATTTTCTGTCATTTTCCTTAACCCAAAAATAAGGGAAAGGGTCCAAAAAGC<br>GCTCGGACAACTGTTGACCGTGATCCGAAGGACTGGCTATACAGTGTTCAC<br>AAAATAGCCAAGCTGAAAATAATGTGTAGCTATGTTCAGTTAGTTTGGCTA<br>GCAAAGATATAAAAGCAGGTCGGAAATATTTATGGGCATTATTATGCAGA<br>GCATCAA |
| SEQ ID NO: 276 Promoter | pTDH3 | TTAGTCAAAAAATTAGCCTTTTAATTCTGCTGTAACCCGTACATGCCCAAA<br>ATAGGGGGCGGGTTACACAGAATATATAACATCGTAGGTGTCTGGGTGAA<br>CAGTTTATTCCTGGCATCCACTAAATATAATGGAGCCCGCTTTTTAAGCTG<br>GCATCCAGAAAAAAAAAGAATCCCAGCACCAAAATATTGTTTTCTTCACC<br>AACCATCAGTTCATAGGTCCATTCTCTTAGCGCAACTACAGAGAACAGGG<br>GCACAAACAGGCAAAAAACGGGCACAACCTCAATGGAGTGATGCAACCTG<br>CCTGGAGTAAATGATGACACAAGGCAATTGACCCACGCATGTATCTATCTC<br>ATTTTCTTACACCTTCTATTACCTTCTGCTCTCTCTGATTTGGAAAAAGCTG<br>AAAAAAAAGGTTGAAACCAGTTCCCTGAAATTATTCCCCTACTTGACTAAT<br>AAGTATATAAAGACGGTAGGTATTGATTGTAATTCTGTAAATCTATTTCTT<br>AAACTTCTTAAATTCTACTTTTATAGTTAGTCTTTTTTTTAGTTTTAAAACA<br>CCAAGAACTTAGTTTCGAATAAACACACATAAACAAACAAA |
| SEQ ID NO: 277 Promoter | pTEF1 | GACAGCCTAGACATCAATAGTCATACAACAGAAAGCGACCACCCAACTTT<br>GGCTGATAATAGCGTATAAACAATGCATACTTTGTACGTTCAAAATACAAT<br>GCAGTAGATATATTTATGCATATTACATATAATACATATCACATAGGAAGC<br>AACAGGCGCGTTGGACTTTTAATTTTCGAGGACCGCGAATCCTTACATCAC<br>ACCCAATCCCCCACAAGTGATCCCCCACACACCATAGCTTCAAAATGTTTC<br>TACTCCTTTTTTACTCTTCCAGATTTTCTCGGACTCCGCGCATCGCCGTACC<br>ACTTCAAAACACCCAAGCACAGCATACTAAATTTCCCCTCTTTCTTCCTCTA<br>GGGTGTCGTTAATTACCCGTACTAAAGGTTTGGAAAAGAAAAAAGAGACC<br>GCCTCGTTTCTTTTTCTTCGTCGAAAAAGGCAATAAAAATTTTTATCACGTT<br>TCTTTTTCTTGAAAATTTTTTTTTTTGATTTTTTTCTCTTTCGATGACCTCCC<br>ATTGATATTTAAGTTAATAAACGGTCTTCAATTTCTCAAGTTTCAGTTTCAT<br>TTTTCTTGTTCTATTACAACTTTTTTTACTTCTTGCTCATTAGAAAGAAAGC<br>ATAGCAATCTAATCTAAGTTTTAATTACAAA |
| SEQ ID NO: 278 SRS | SRS_A | GAGATCCCCAAACAGTTTAATCTCTGATTAACTCTTGCGTCGTATAGTCGG<br>GCTTAACTCTATACTCAAAATCACTAACAAGACGTAGACGCAAGACGATA<br>AGACCGGGCAGGATACTATCACTCAATACAGTTCAGATATCTCCATCTAAC<br>TGTACTCTACTCAAAAACGTCTTACTAAAGAAGAACGTCTCCCCAACACAT<br>GTAGGAAGGAAGTGATTACTTATCTTTTGGCTAAATCTACATAATTAGTCA<br>GCGAACATTCTAGACAGAGAGTGAAATCTGACACGTGAGATTAGTGCTTA<br>TACTCTGATTAGGCTCAGTGAAACTAGCTGTGCATGTACCGTGATTATTAG<br>GTTGACATAGGAATTTAGTGCCTAATATCGGCTCGATTATAAATATCAGTA<br>ATTCGATATCGTCATGTCTTTATGCTTACAGGTATAGTAATTTGGCCTTAGT<br>GGAACGATCAATCGGCTTCTGTAATATTATTCAACCTTCCCT |
| SEQ ID NO: 279 SRS | SRS_B | ATCAATTTGTGATTACTTTGCTAGGTAACGCCACTACTGGTGTTATAATTGC<br>TGTTACTTAAGCGCCTTGTAATCGATATAAGTGAAAATACAAAACGCAGCC<br>TACTGTTCAATCGGAACTTTAGTATATTCGCTGAGGACTAGTACGTGGCAG<br>AATCCAGTTATAATGTTTTGAATCGCTTTTAAGGTACTGAAGTAATCCACA<br>GGACGCCAAGCTCTTATAGCACAGTGGGATATATTTGCACGTGATTATTGC<br>AAAAGAGCTAAGGGTCGTACTTCACGTCTTTTAACTGAGTACAACCCAAAT<br>TTGGTTCGCTTCGCAAGTTGATAGCGTAGCGACACGTACAGTTGGTTTGAA<br>ACAGTAGTACTTCCTTTTAATTCGGAGGCTTATTGTACGGAAAGTGTTCTG<br>TTAATTAAGGTAGACCAGCAGAACACCGCGCACCAGGGATTGCATATCTTT<br>AGGGTATTTCGAGATTGCATCCCATTGAAATCGTACCTTT |
| SEQ ID NO: 280 SRS | SRS_C | GAAGACTAACGAACGAGGTGGTATATAGTTACCCTATGTAAAATCGTTAA<br>TTGTCATTAGACAATGTTTCAGGAGTAGAATTCAGCTAGCTGTTAGCCCAC<br>TGGCACACGCTAGGACGCTATCAGGACGGTCTTTGAACCTATAACTCAGTA<br>TATGGTTTTAGACCTATAATCTGCTTCTAAGGCACGCGGGGGAGTAACTTA<br>GATACTAGTGCTTCCAGGAAAATCTGGCGCGATAATAGCCCGATCTTCTAA<br>TAGACTATCCCTACCAAAAGTTATAAATCATTGTTCTCTTGACGTTAACAT<br>CACTTGCTGAAAATTAGAATGTGAAGAAAACCATAAACAAATTAGCCTGG |

TABLE 6-continued

List of Regulatory and Other Elements

| SEQ ID and Type | Name | Sequence |
|---|---|---|
| | | CAGACAGTGAATATACTCTACGTTGAACATATACAAAAATAGAAGCGCCG GAAAGAAGATCCTTCCCAGTAGAGTCCGTTAAACTAATTTCCTAATTGCTA AATACTGTATCTACCTGATAATGGGGTCGGTTACTTCAGTTTAT |
| SEQ ID NO: 281 SRS | SRS_D | CTCGTAACTTGATTTAATAACGGAGGCTATTGAACTTAAAATCGCATCTGG CTGTTAAATTCAATAAACTTGCTTTCAGGTTAACTTCCTTTGATTAAGTCGT GAATTAAGATCTTATTACAACTCTGGTACGTCCTAAGTTAGATTAAAGTAC TGTTGGAGGAACGGAATAATATTTCTTGTGTTACGCAGCTAGTGAACCAGT GTCACAGGAGGTGTAACAACCGGTTGAAATTCTAACTTTTGAAGCTTTACC TAAGGGTACTGTATAAGGATCACATTGTTAGTACAACGCTAGTTCGTAGGC GTTCAAACTTAATTGTTTAGTAGTCCGCACTTGACTAACTGACGCTCCTTG GTCTGCTCTTCGTAATTAGGCTTTCGAAAGGTACGATGGAATACTAAGTAT AATAACAGTTGTCTGACAACTACGGTACGTATTTGATGTTGAGGCAGTGAG CTAACTCCACTTAGTGTGTAACCTTACGTATCATATA |
| SEQ ID NO: 282 SRS | SRS_G | ATGAGTTAACGTAGATTACTTTCCGTTAGTGTAACGGACAAGATGACACAG TATTGAAACGCTCCTCTATCTTTGTGGGTGTTGAGGGAGGAGAGAGTTATT AGTCTAGACGCTATATATCACAGAGTCGAGTGCCCAATAATATAGCAGGT AGACGCCAACTTAACTACTGGATGTGAGTTAGAGAGGAATATACTGTTTTA TTAACTCGTACCGTAGTGGTTTCTGGCGAGAATTCGCCGGCTTAAAATCTA TTGACTAACTAGAATTAGCTTAAAGTGGACCTTATTGAATCTCACCGGGTT ATCGCGACATTTATATTATCGAAGGGTCCAGCTTGGGGTTTGTTTGGAAGG TTGACTTGTTGTTGTAGTTGTATCACTAATAATTACGATTCTCAACGACCGG CCCAAAGATTGCCTGGGTTAAATTCAGCGTCTGATGTATACTTAGCTCTTC GCAAGTAGTGTTCTAATTAAAGATCACTTCAACTTATCTTC |
| SEQ ID NO: 283 SRS | SRS_H | AAGGTAACTTAGGCTGACGACGCAATAATGCACGCTCGCGTGTGATGAGA TTACATCAGTAAGAATTCATATCTCGATATGGGATAATTACGGGCTCACAC TCTAGGAATACCAAGAACAGTAATGTTTCCTTATTAATATGTAGATAAGGA TCTTCTTAAAGTTTAATTGATGGCGAATTCCAAATAGTGACTTAACTTTCGC GCAGAGTATCGCAGGACAAGGTTAGCTTTTCGTAAGCCTGATGTTATGCCA TAACTAGCCACCTTGTAATCCCCGCGCTCAGTAAATCTATCTACTTATTTGC TTCACTTCTTCACGGAGAGTACTGATTTTCTTCTCTCAATACTACTGACTAC CTTAGGGCGACATACTTTAGTTCTGCATAAGCGTCAACCTCTTGCCTAAGG GTATGGATCCTTGTTAAGCCTTATTCCATATAGTTGAGCTGAAGAACAGAT CCCTCAACTCGAGTGCGACTAGTAGCTAGTTACGAACAC |
| SEQ ID NO: 284 SRS | SRS_J | GGTCATTGAGGCGGTAAGAATCTGATTTATCTAGATCTATAGCAACGTCAA ATAATTCAAATCCCGTACTTTTCAAGATTCTGAGGGTTAAGGTCTTGATTG TGATTCTAAATACTTGTAGGTACCGAGTAATAGACGCGCACTCAGATTTGG TCTAATACGATTATTTACCCATAGAGAGAGTAATCGTCTATGGCCCGTAGT TAGCAAGGTTCAACGTGTATTATGTACTGAGTACGCAGATCTGATTACCCT ATAATTTCCAAGATATTAGTGATTCTAACGGATATAGTCAATACCTCCCAA TTCCCCACGCTTCGATTGTAGTATTTGATTCGGCTGACAAACGCCGACAAG ATTCGCTGTAACTCTTTGGCTAATAGAAAAGTAAATCAACACGCGTTCTTA AATTCTTGACATGTAAGTACTTGGAACAATCTTACCTGTTATCCATTATCTG TTTATCGATCTTACCTAACCATCCAGTTTGCCTGAGTGGG |
| SEQ ID NO: 285 Terminator | tTDH1 | ATAAAGCAATCTTGATGAGGATAATGATTTTTTTTTGAATATACATAAATA CTACCGTTTTTCTGCTAGATTTTGTGAAGACGTAAATAAGTACATATTACTT TTTAAGCCAAGACAAGATTAAGCATTAACTTTACCCTTTTCTCTTCTAAGTT TCAATACTAGTTATCACTGTTTAAAAGTTATGGCGAGAACGTCGGCGGTTA AAATATATTACCCTGAACGTGGTGAATTGAAGTTCTAGGATGGT |
| SEQ ID NO: 286 Terminator | tENO1 | AGCTTTTGATTAAGCCTTCTAGTCCAAAAAACACGTTTTTTTGTCATTTATT TCATTTTCTTAGAATAGTTTAGTTTATTCATTTTATAGTCACGAATGTTTTA TGATTCTATATAGGGTTGCAAACAAGCATTTTTCATTTTATGTTAAAACAA TTTCAGGTTTACCTTTTATTCTGCTTGTGGTGACGCGTGTATCCGCCCGCTC TTTTGGTCACCCATGTATTTAATTGCATAAATAATTCTTAAAAGTGGAGCT AGTCTATTTCTATTTACATACCTCTCATTTCTCATTTCCTCCT |
| SEQ ID NO: 287 Terminator | tSSA1 | GCCAATTGGTGCGGCAATTGATAATAACGAAAATGTCTTTTAATGA TCTGGGTATAATGAGGAATTTTCCGAACGTTTTTACTTTATATATAT ATATACATGTAACATATATTCTATACGCTATAGAGAAAGGAAATTT TTCAATTAAAAAAAAAAATAGAGAAAGAGTTTCACTTCTTGATTATC GCTAACACTAATGGTTGAAGTACTGCTACTTTAATTTTATAGATAG GCAAAAAAAAAATTATTCGGGGCGAGCTGGGAATTGAACCCAGGGC CTCTCGCATGCTTTGTCTTC |

TABLE 6-continued

List of Regulatory and Other Elements

| SEQ ID and Type | Name | Sequence |
|---|---|---|
| SEQ ID NO: 288 Terminator | tADH1 | GCGAATTTCTTATGATTTATGATTTTTATTATTAAATAAGTTATAAAAAA ATAAGTGTATACAAATTTTAAAGTGACTCTTAGGTTTTAAAACGAAAATTC TTATTCTTGAGTAACTCTTTCCTGTAGGTCAGGTTGCTTTCTCAGGTATAGC ATGAGGTCGCTCTTATTGACCACACCTCTACCGGCATGCCGAGCAAATGCC TGCAAATCGCTCCCCATTTCACCCAATTGTAGATATGCTAACTCC |
| SEQ ID NO: 289 Terminator | tCYC1 | ATCATGTAATTAGTTATGTCACGCTTACATTCACGCCCTCCCCCCACATCCG CTCTAACCGAAAAGGAAGGAGTTAGACAACCTGAAGTCTAGGTCCCTATT TATTTTTTTATAGTTATGTTAGTATTAAGAACGTTATTTATATTTCAAATTTT TCTTTTTTTTCTGTACAGACGCGTGTACGCATGTAACATTATACTGAAAACC TTGCTTGAGAAGGTTTTGGGACGCTCGAAGGCTTTAATTTGC |
| SEQ ID NO: 290 Terminator | tHUG1 | AGTATGCTTCTCTTTTTTTTTGTAGGCCAGTGATAGGAAAGAACAATAGAA TATAAATACGTCAGAATATAATAGATATGTTTTTATATTTAGACCTCGTAC ATAGGAATAATTGACGTTTTTTTTGGCCAACATTTGAAATTTTTTTTTGTTA CCTCGCGCTGAGCCCAAACGGGCTCCACTACCCGCCGCGGTCGCCATTTTG GGAAGTCATCCGTCCCAAAAAGGAAATAGCCATAACATGTCGTTACTGTTT TGGAACATCGCCCGTTTCGCCCGATTCCGCCTCAGCGGGTATAAAAAGAG ATCTTTTTTTTTCCTGGCTGTCCCTTCCCATTTTTAAATGTCTTATCTGCTCC TTTGTGATCTTACGGTCTCACTAACCTCTCTTCAACTGCTCAATAATTTCCC GCTATGCAAAATTCCCAAGACTACTTTTACGCTCAAAATCGCTCCCAACAA CAACAAGCCCCTTCCACATTGCGTACCGTGACCATGGCGGAATTTAG |
| SEQ ID NO: 291 Terminator | tSPG5 | AAAGACGTTGTTTCATCGCGCTATTACCAAGAAGGTTACTTTACTTGTTCTT GCACATGGACGCACGTTGTGTGTTCATATATATATATATATATATATATAT ATATTTGTGCTTGTTTTCATTGTCTCTATAGTTAATACATTCTATTTTTATCG TTATATTTGCATTCTCTTCGCATAAAAACTTCATGAAAATTCGGCAGAAAA TAAGCCATATATGTACTTTATCCATAGGCAAAGAAAAGCACTTAACGAGA ATATACAACAATTGCACTAGTACTGCATGTATATACTCTTATGATTATAGC GGCAAGAAAACAAATATAAACACACTAACAGATGAATTCGAATGAAGATA TACATGAAGAACGCATTGAAGTTCCACGAACTCCCCATCAAACCCAGCCA GAGAAAGACTCTGATCGCATCGCTCTCAGGGATGAAATATCAGTACCAGA AGGCGATGAAAAAGCATATTCGGATGAGAAAGTAGAAATGGCAACCA |
| SEQ ID NO: 292 Promoter | pGAL10 | ATCTGTTAATAGATCAAAAATCATCGCTTCGCTGATTAATTACCCCAGAAA TAAGGCTAAAAAACTAATCGCATTATTATCCTATGGTTGTTAATTTGATTC GTTGATTTGAAGGTTTGTGGGGCCAGGTTACTGCCAATTTTTCCTCTTCATA ACCATAAAAGCTAGTATTGTAGAATCTTTATTGTTCGGAGCAGTGCGGCGC GAGGCACATCTGCGTTTCAGGAACGCGACCGGTGAAGACCAGGACGCACG GAGGAGAGTCTTCCGTCGGAGGGCTGTCGCCCGCTCGGCGGCTTCTAATCC GTACTTCAATATAGCAATGAGCAGTTAAGCGTATTACTGAAAGTTCCAAAG AGAAGGTTTTTTTAGGCTAAGATAATGGGGCTCTTTACATTTCCACAACAT ATAAGTAAGATTAGATATGGATATGTATATGGTGGTATTGCCATGTAATAT GATTATTAAACTTCTTTGCGTCCATCCAAAAAAAAAGTAAGAATTTTTGAA AATTCAATATAA |
| SEQ ID NO: 321 Flanking homology | ui12 | TCCTACAACGATATCATTCACTTGAAGGAATACAAAATTGATAATGATCCA ATTGAAAAGTACGTTAAGAACAGCGGCAATAATTTGGGGATTTGTTTCTAC AAAGAATAAAAATTCATGTTCGACATATAGATAGCAGGGTAATGTACGTG TATATTTTAATGTAATAAAGAGGCCTTACTAGACGGTAAAGTTAAGAATAT CGAGTGAACTTTTCCTTAAGATAAAGGTAAATATAGTCGAGTATTTATTTA TTATTCTTTTCCACTATACAGTATTTAAAATTCTGTAAGAAATTGATTCTAC ATACATAAGACAAACGAACAGGTCAGAGAGAATCAGATTTTTGGTTAGCA AGAATACATTTTGGAGAAGAAAGACATTAACTCCACCTTACTGTATCATCT TATTTGCTTTTTCACTCCTTCCTAATATTTTTTTATTTTATTTTGAATTTCTT CCTATTTCTGATGCATTGAACAGATCGTAATCTGTAAGTAAATA |
| SEQ ID NO: 322 Flanking homology | di12 | AAATCTTGGCTCCGTTGTGTACAAAACTTCTTAATGAATATATATATATTTT TCCCTTATTTTATCTTTTTTTTTCGAATTTTTTATGTAAACATTCTTATACTG GAACAATAGATGGCTAATGAGTCCCTATAATTTCGATTTTAGATGTTAACG CTTCATTTCTTTTCATATAAAAGACTACCTGCCAAATGTATTTTCTCCTGAG TAAGTGACATACAAAAACCCGTCCTTATCCTTGTGTTCTTGATATATGGCA GACATCAACGCCGCAGTAGGTGGCAAAGTATCATTGACAAAAATGAAGAT GGCCTTCTCAGGGGGTAGCATAATTCTCTTTCTTATAACATAAACAAATTG |

TABLE 6-continued

List of Regulatory and Other Elements

| SEQ ID and Type | Name | Sequence |
|---|---|---|
| | | CCCTACGGTAAGGTCAGCAGGAACTAGATATTTACGCTTATCAATCTCTGG AATATCTGACTTTTCAGCTTTTTCGCAAATCACAGGTATCCTATTCTTGAAC CTGTCAGCAATCC |

Table 6 Legend: Non-coding DNA regions (regulatory and other) referenced in the FIGURES are listed in Table 6. Flanking Homology regions direct recombination at specific genomic loci. Flanking homology upstream sequences are denoted with a "u", and downstream with a "d'". "I" indicates an intergenic integration site, e.g., ui7, di7 are the regions flanking intergenic region 7. Integrations that delete an open reading frame have flanking homology with the deleted gene indicated, e.g., uPEP4, dPEP4 are the regions flanking the PEP4 gene. Synthetic Recombination Sequences (SRS) direct internal recombination of two DNA constructs targeted for integration at the same locus. Linkers are short sequences used in assembly the DNA constructs, they are intervening between the indicated parts. Linkers G1, G7, G10, RG1 and LTTDH1 contain the last 36 bp of the upstream DNA part; in cases where these linkers are used assume that the linker reconstitutes sequence omitted from the upstream part to create a seamless junction with the downstream part. Linkers D0 and D9 are terminal linkers that direct entry of the DNA constructs into cloning vectors and are not integrated into the genome. Where no linker is shown between parts, the junction is also seamless.

Although the present disclosure has been described with reference to the specific embodiments thereof, it should be understood by those skilled in the art that various changes may be made and equivalents may be substituted without departing from the true spirit and scope of the disclosure. In addition, many modifications may be made to adapt a particular situation, material, composition of matter, process, process step or steps, to the objective, spirit and scope of the present disclosure. All such modifications are intended to be within the scope of the claims appended hereto.

SEQUENCE LISTING (323 sequences)

SEQ ID NO: 1 - DNA, 1635 bp, Artificial Sequence
  Cannabidiolic Acid (CBDA) Synthase Codon opt 2 Codon optimized
atgaaatgctctaccttttctttctggttcgtttgtaagattatcttcttcttcttctccttcaacatccaaacctctatcgctaaccctcgtgaaaactttttgaaatgtttttcccaatacatcccaaataacgctactaatttgaagttggtttacacccaaaacaacccattgtatatgtccgttttaaactctactattcacaatttgcgttttacctctgatactacccctaaaccattggtcattgttaccccatcccatgtttctcatatccaaggtactatcttgtgttctaaaaaggttggtttgcaaattagaactcgttccggtggtcacgattctgaaggtatgtcttacatttctcaagttcctttcgtcattgtcgacttgagaaacatgagatccatcaaaattgatgttcactctcaaactgcttgggtcgaagccggtgccactttaggtgaggtctactattgggttaacgagaagaacgaaaacttgtctttggctgccggttactgtccaactgtctgtgctggtggtcattttggtggtggtggttacggtccattgatgagaaactacggtttggctgctgataacattattgatgctcacttagttaacgtccacggtaaagtcttggatagaaagtccatgggtgaagacttgttctgggctttaagaggtggtggtgctgaatccttcggtattattgttgcttggaaaatcagattggtcgctgttccaaaatccaccatgttttctgtcaagaaaatcatggaaattcatgaattagttaagttggtcaacaaatggcaaaacattgcctataaatacgacaaggatttgttgttgatgactcatttcatcactcgtaacatcactgataatcaaggtaagaacaagactgctatccatacttacttctcttccgtcttcttgggtggtgttgactctttggtcgatttgatgaacaaatcctttccagagttaggtattaagaagactgactgtagacaattatcttggattgacactattatcttctactctggtgttgtcaattacgatactgataactttaacaaggaaattttgttggaccgttctgctggtcaaaacggtgccttcaagattaagttagattacgttaagaagccaatcccagaatctgtcttcgtccaaattttggagaaattgtatgaagaggacattggtgctggtatgtacgccttgtatccttacggtggtatcatggacgagatctccgaatctgccatcccttttcctcatcgtgctggtatcttgtacgagttgtggtacatctgttcctgggagaagcaagaagataatgaaaagcacttgaactggattagaaatatttataatttcatgactccatacgtttctaagaacccacgtttggcttacttaaattacagagatttggatattggtatcaacgaccctaagaaccctaacaactacactcaagctagaatttggggtgagaaatatttcggtaagaacttcgatagattggtcaaggttaaaactttagttgatccaaataacttttttagaaacgaacaatctattccaccattgccaagacacagacactag

SEQ ID NO: 2 - DNA, 1635 bp, Artificial Sequence
  Cannabidiolic Acid (CBDA) Synthase Codon opt 5 Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 3 - protein, 544 aa, Cannabis sativa
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 4 - DNA, 2049 bp, Unknown
  Saccharomyces sp.
atgtttttcaacagactaagcgctggcaagctgctggtaccactctccgtggtcctgtacgcccttttcgtggtaatattacctttacagaattctttccactcctccaatgttttagttagaggtgccgatgatgtagaaaactacggaactgttatcggtattgacttaggtactacttattcctgtgttgctgtgatgaaaaatggtaagactgaaattcttgctaatgagcaaggtaacagaatcaccccatcttacgtggcattcaccgatgatgaaagattgattggtgatgctgcaaagaaccaagttgctgccaatcctcaaaacaccatcttcgacattaagagattgatcggtttgaaatataacgacagatctgttcagaaggatatcaagcacttgccatttaatgtggttaataaagatgggaagcccgctgtagaagtaagtgtcaaaggagaaaagaaggtttttactccagaagaaatttctggtatgatcttgggtaagatgaaacaaattgccgaagattatttaggcactaaggttacccatgctgtcgttactgttcctgcttatttcaatgacgcgcaaagacaagccaccaaggatgctggtaccatcgctggtttgaacgttttgagaattgttaatgaaccaaccgcagccgccattgcctacggtttggataaatctgataaggaacatcaaattattgtttatgatttgggtggtggtactttcgatgtctctctattgtctattgaaaacggtgttttcgaagtccaagccacttctggtgatactcatttaggtggtgaagattttgactataagatcgttcgtcaattgataaaagctttcaagaagaagcatggtattgatgtgtctgacaacaacaaggccctagctaaattgaagagagaagctgaaaaggctaaacgtgccttgtccagccaaatgtccacccgtattgaaattgactccttcgttgatggtatcgacttaagtgaaaccttgaccagagctaagtttgaggaattaaacctagatctattcaagaagaccttgaagcctgtcgagaaggttttgcaagattctggtttggaaaagaaggatgttgatgatatcgttttggttggtggttctactagaattccaaaggtccaacaattgttagaatcatactttgatggtaagaaggcctccaagggtattaacccagatgaagctgttgcatacggtgcagccgttcaagctggtgtcttatccggtgaagaaggtgtcgaagatattgttttattggatgtcaacgctttgactcttggtattgaaaccactggtggtgtcatgactccattaattaagagaaatactgctattcctacaaagaaatcccaaattttctctactgccgttgacaaccaaccaaccgttatgatcaaggtatacgagggtgaaagagccatgtctaaggacaacaatctattaggtaagtttgaattaaccggcattccaccagcaccaagaggtgtacctcaaattgaagtcacatttgcacttgacgctaatggtattctgaaggtgtctgccacagataagggaactggtaaatccgaatctatcaccatcactaacgataaaggtagattaacccaagaagagattgatagaatggttgaagaggctgaaaaattcgcttctgaagacgcttctatcaaggccaaggttgaatctagaaacaaattagaaaactacgctcactctttgaaaaaccaagttaatggtgacctaggtgaaaaattggaagaagaagacaaggaaaccttattagatgctgctaacgatgttttagaatggttagatgataactttgaaaccgccattgctgaagactttgatgaaaagttcgaatctttgtccaaggtcgcttatccaattacttctaagttgtacggaggtgctgatggttctggtgccgctgattatgacgacgaagatgaagatgacgatggtgattatttcgaacacgacgaattgtag

SEQ ID NO: 5 - protein, 682 aa, Unknown
  Saccharomyces sp.
MFFNRLSAGKLLVPLSVVLYALFVVILPLQNSFHSSNVLVRGADDVENYGTVIGIDLGTTYSCVAVMKNGKTEILANEQGNRITPSYVAFTDDERLIGDAAKNQVAANPQNTIFDIKRLIGLKYNDRSVQKDIKHLPFNVVNKDGKPAVEVSVKGEKKVFTPEEISGMILGKMKQIAEDYLGTKVTHAVVTVPAYFNDAQRQATKDAGTIAGLNVLRIVNEPTAAAIAYGLDKSDKEHQIIVYDLGGGTFDVSLLSIENGVFEVQATSGDTHLGGEDFDYKIVRQLIKAFKKKHGIDVSDNNKALAKLKREAEKAKRALSSQMSTRIEIDSFVDGIDLSETLTRAKFEELNLDLFKKTLKPVEKVLQDSGLEKKDVDDIVLVGGSTRIPKVQQLLESYFDGKKASKGINPDEAVAYGAAVQAGVLSGEEGVEDIVLLDVNALTLGIETTGGVMTPLIKRNTAIPTKKSQIFSTAVDNQPTVMIKVYEGERAMSKDNNLLGKFELTGIPPAPRGVPQIEVTFALDANGILKVSATDKGTGKSESITITNDKGRLTQEEIDRMVEEAEKFASEDASIKAKVESRNKLENYAHSLKNQVNGDLGEKLEEEDKETLLDAANDVLEWLDDNFETAIAEDFDEKFESLSKVAYPITSKLYGGADGSGAADYDDEDEDDDGDYFEHDEL

SEQ ID NO: 6 - DNA, 1692 bp, Unknown
  Saccharomyces sp.
atgagattaagaaccgccattgccacactgtgcctcacggcttttacatctgcaacttcaaacaatagctacatcgccaccgaccaaacacaaaatgcctttaatgacactcacttttgtaaggtcgacaggaatgatcacgttagtcccagttgtaacgtaacattcaatgaattaaatgccataaatgaaaacattagagatgatctttcggcgttattaaaatctgatttcttcaaatactttcggctggatttatacaagcaatgttcattttgggacgccaacgatggtctgtgcttaaaccgcgcttgctctgttgatgtcgtagaggactgggatacactgcctgagtactggcagcctgagatcttgggtagtttcaataatgatacaatgaaggaagcggatgatagcgatgacgaatgtaagttcttagatcaactatgtcaaaccagtaaaaaacctgtagatatcgaagacaccatcaactactgtgatgtaaatgactttaacggtaaaaacgccgttctgattgatttaacagcaaatccggaacgatttacaggttatggtggtaagcaagctggtcaaatttggtctactatctaccaagacaactgttttacaattggcgaaactggtgaatcattggccaaagatgcattttatagacttgtatccggtttccatgcctctatcggtactcacttatcaaaggaatatttgaacacgaaaactggtaaatgggagcccaatctggatttgtttatggcaagaatcgggaactttcctgatagagtgacaaacatgtatttcaattatgctgttgtagctaaggctctctggaaaattcaaccatatttaccagaattttcattctgtgatctagtcaataaagaaatcaaaaacaaaatggataacgttatttcccagctggacacaaaaatttttaacgaagacttagtttttgccaacgacctaagtttgactttgaaggacgaattcagatctcgcttcaagaatgtcacgaagattatggattgtgtgcaatgtgatagatgtagattgtggggcaaaattcaaactaccggttacgcaactgccttgaaaattttgtttgaaatcaacgacgctgatgaattcaccaaacaacatattgttggtaagttaaccaaatatgagttgattgcactattacaaactttcggtagattatctgaatctattgaatctgttaacatgttcgaaaaaatgtacgggaaaaggttaaacggttctgaaaacaggttaagctcattcttccaaaataacttcttcaacattttgaaggaggcaggcaagtcgattcgttacaccatagagaacatcaattccactaaagaaggaaagaaaaagactaacaattctcaatcacatgtatttgatgatttaaaaatgcccaaagcagaaatagttccaaggccctctaacggtacagtaaataaatggaagaaagcttggaatactgaagttaacaacgttttagaagcattcagatttatttatagaagctatttggatttacccaggaacatctgggaattatctttgatgaaggtatacaaattttggaataaattcatcggtgttgctgattacgttagtgaggagacacgagagcctatttcctataagctagatatacaataa

SEQ ID NO: 7 - protein, 563 aa, Unknown
  Saccharomyces sp.
MRLRTAIATLCLTAFTSATSNNSYIATDQTQNAFNDTHFCKVDRNDHVSPSCNVTFNELNAINENIRDDLSALLKSDFFKYFRLDLYKQCSFWDANDGLCLNRACSVDVVEDWDTLPEYWQPEILGSFNNDTMKEADDSDDECKFLDQLCQTSKKPVDIEDTINYCDVNDFNGKNAVLIDLTANPERFTGYGGKQAGQIWSTIYQDNCFTIGETGESLAKDAFYRLVSGFHASIGTHLSKEYLNTKTGKWEPNLDLFMARIGNFPDRVTNMYFNYAVVAKALWKIQPYLPEFSFCDLVNKEIKNKMDNVISQLDTKIFNEDLVFANDLSLTLKDEFRSRFKNVTKIMDCVQCDRCRLWGKIQTTGYATALKILFEINDADEFTKQHIVGKLTKYELIALLQTFGRLSESIESVNMFEKMYGKRLNGSENRLSSFFQNNFFNILKEAGKSIRYTIENINSTKEGKKKTNNSQSHVFDDLKMPKAEIVPRPSNGTVNKWKKAWNTEVNNVLEAFRFIYRSYLDLPRNIWELSLMKVYKFWNKFIGVADYVSEETREPISYKLDIQ

SEQ ID NO: 8 - DNA, 1569 bp, Unknown
  Saccharomyces sp.
atgaagttttctgctggtgccgtcctgtcatggtcctccctgctgctcgcctcctctgttttcgcccaacaagaggctgtggcccctgaagactccgctgtcgttaagttggccaccgactccttcaatgagtacattcagtcgcacgacttggtgcttgcggagttttttgctccatggtgtggccactgtaagaacatggctcctgaatacgttaaagccgccgagactttagttgagaaaaacattaccttggcccagatcgactgtactgaaaaccaggatctgtgtatggaacacaacattccagggttcccaagcttgaagattttcaaaaacagcgatgttaacaactcgatcgattacgagggacctagaactgccgaggccattgtccaattcatgatcaagcaaagccaaccggctgtcgccgttgttgctgatctaccagcttaccttgctaacgagacttttgtcactccagttatcgtccaatccggtaagattgacgccgacttcaacgccaccttttactccatggccaacaaacacttcaacgactacgactttgtctccgctgaaaacgcagacgatgatttcaagctttctatttacttgccctccgccatggacgagcctgtagtatacaacggtaagaaagccgatatcgctgacgctgatgtttttgaaaaatggttgcaagtggaagccttgccctactttggtgaaatcgacggttccgttttcgcccaatacgtcgaaagcggtttgcctttgggttacttattctacaatgacgaggaagaattggaagaatacaagcctctctttaccgagttggccaaaaagaacagaggtctaatgaactttgttagcatcgatgccagaaaattcggcagacacgccggcaacttgaacatgaaggaacaattccctctatttgccatccacgacatgactgaagacttgaagtacggtttgcctcaactctctgaagaggcgtttgacgaattgagcgacaagatcgtgttggagtctaaggctattgaatctttggttaaggacttcttgaaaggtgatgcctccccaatcgtgaagtcccaagagatcttcgagaaccaagattcctctgtcttccaattggtcggtaagaaccatgacgaaatcgtcaacgacccaaagaaggacgttcttgttttgtactatgccccatggtgtggtcactgtaagagattggccccaacttaccaagaactagctgatacctacgccaacgccacatccgacgttttgattgctaaactagaccacactgaaaacgatgtcagaggcgtcgtaattgaaggttacccaacaatcgtcttatacccaggtggtaagaagtccgaatctgttgtgtaccaaggttcaagatccttggactctttattcgacttcatcaaggaaaacggtcacttcgacgtcgacggtaaggccttgtacgaagaagcccaggaaaaagctgctgaggaagccgatgctgacgctgaattggctgacgaagaagatgccattcacgatgaattgtaa

SEQ ID NO: 9 - protein, 522 aa, Unknown
  Saccharomyces sp.
MKFSAGAVLSWSSLLLASSVFAQQEAVAPEDSAVVKLATDSFNEYIQSHDLVLAEFFAPWCGHCKNMAPEYVKAAETLVEKNITLAQIDCTENQDLCMEHNIPGFPSLKIFKNSDVNNSIDYEGPRTAEAIVQFMIKQSQPAVAVVADLPAYLANETFVTPVIVQSGKIDADFNATFYSMANKHFNDYDFVSAENADDDFKLSIYLPSAMDEPVVYNGKKADIADADVFEKWLQVEALPYFGEIDGSVFAQYVESGLPLGYLFYNDEEELEEYKPLFTELAKKNRGLMNFVSIDARKFGRHAGNLNMKEQFPLFAIHDMTEDLKYGLPQLSEEAFDELSDKIVLESKAIESLVKDFLKGDASPIVKSQEIFENQDSSVFQLVGKNHDEIVNDPKKDVLVLYYAPWCGHCKRLAPTYQELADTYANATSDVLIAKLDHTENDVRGVVIEGYPTIVLYPGGKKSESVVYQGSRSLDSLFDFIKENGHFDVDGKALYEEAQEKAAEEADADAELADEEDAIHDEL

SEQ ID NO: 10 - DNA, 3348 bp, Unknown
  Saccharomyces sp.
atgcgtctacttcgaagaaacatgttagtattgacactgctcgtttgtgtgttttcatccatcatttcatgctcaatcccattgtcgtctcgcacctcaaggcggcagatagtggaagatgaagttgcctccactaaaaagctcaatttcaactatggtgtggataaaaatataaactcgcccattcctgctccaagaaccactgaaggtttaccaaatatgaaactcagctcatatccaactcctaacttattgaatactgctgataatcgacgtgctaacaaaaaaggacgtagggctgccaattctataagtgtaccctatttggagaatcgttccttgaacgaactgagtttatcagatatactaatcgcagccgacgttgagggtggacttcatgctgtagatagaagaaatggtcatatcatatggtcaatcgaaccagaaaattttcaacctctgatagaaatacaagaaccttcgaggttagaaacatatgaaacgttgattatagaacctttcggtgatgggaacatttactactttaacgcccatcaagggttacaaaaactgcctttatccatacgacaacttgtatcaacttccccgctgcacttgaaaacaaatattgtggttaatgactctggaaaaattgttgaagatgaaaaggtctacactggatcgatgagaactataatgtatactataaacatgttgaatggtgaaattatatcagcgttcggacctggttcaaaaaacgggtatttcgggagccagagtgtggattgctcacctgaggagaagataaaacttcaggaatgtgaaaatatgattgtaataggcaaaactatttttgagctgggaattcactcttatgatggagcaagctacaatgtcacttactctacatggcagcaaaatgttttagatgttcccctagcgcttcagaatacattttcaaaggacggcatgtgcatagcgcctttccgtgataaatcattgctagcaagcgatttagattttagaattgctagatgggtttctccgacattccccggaattattgttgggcttttcgatgtgtttaatgatctccgcaccaatgaaaatatactggtaccgcatccctttaatcctggtgatcatgaaagtatatcgagtaacaaagtttacttggatcagacttcgaacctctcctggtttgcattatctagtcagaattttccatctttagtcgaatcagctcccatatcaagatacgcttccagtgaccgttggagggtgtcttcaatttttgaagatgagactttattcaagaacgcaatcatgggtgttcatcagatatataataatgaatatgatcacctttatgaaaactatgaaaaaacgaatagtttggacactacgcacaaatatccacctctgatgattgattcgtccgttgatacaaccgatttacatcagaataacgagatgaattcactaaaggaatacatgtcaccagaagaccttgaggcatatagaaaaaagatacacgagcaaatatcgagagaattagatgaaaagaaccaaaattctttgctactgaagtttggaagtctagtatatcgaattatagagactggagtatttctgttgttatttctcattttttgtgcaatactacaaagattcaaaattttgccgccactatatgtattattatccaaaattggatttatgcctgaaaaggaaatccccatagttgagtcgaaatcgctaaattgtccctcttcatcggaaaatgtaaccaagccattcgatatgaaatcagggaagcaagttgtttttgaaggtgctgtgaacgatggaagtctaaaatctgaaaaagataacgatgatgctgatgaagatgatgaaaaatcactagatttaaccacagaaaagaagaagaggaaaagaggttcgagaggaggcaaaaagggccgaaaatcacgcattgcaaatataccaaactttgagcaatctttaaaaaatttggtagtatccgaaaaaattttaggttacggttcatcaggaacagtagtttttcagggaagttttcaaggaagacctgttgcggtaaagagaatgttaattgatttttgtgacatagctttaatggaaataaaacttttgactgaaagcgatgatcaccctaacgtcatacgatactactgttcagaaacaacagacagatttttgtatattgctttagagctctgcaatttgaaccttcaagatttggtggagtctaagaatgtatcagatgaaaacctgaaattacagaaagagtataatccaatttcgttattgagacaaatagcgtccggggtagcacatttacattctttaaagattatccatcgagatttaaagcctcaaaatattctcgtttctacttcgagtaggtttactgccgatcagcaaacaggagcagaaaatcttcgaattttgatatcagactttggtctttgcaaaaaactagactctggtcagtcttcatttagaacaaatttgaataacccttctggcacaagtggttggagggccccagagctgcttgaagaatcaaacaatttgcagtgccaagtcgaaacggaacactcttctagtaggcatacagtagtttcatctgattctttttatgatccgttcaccaagaggaggctaacaagatctattgatattttttctatgggatgtgtattctattatatcctatccaaagggaagcatccatttggagataaatattcacgtgaaagcaatatcataagaggaatattcagtcttgatgaaatgaaatgtctacatgatagatccttaattgcagaagctacagatctgatctcccaaatgattgatcacgatccgttaaaaagacctactgctatgaaagttctaaggcatccgttgttttggccaaagtcgaaaaaattggagttccttttaaaagttagtgataggcttgaaattgaaaacagagaccctccaagtgccctgttaatgaaatttgacgccggttctgactttgtaatacccagtggagattggactgtcaagtttgataaaacattcatggacaaccttgaaaggtacagaaaataccattcatcaaagttaatggatctattaagagcacttaggaataaatatcatcattttatggatttacctgaagatatagcagaactaatggggccggtacccgatggattttacgattacttcaccaagcgttttccaaacctattaataggtgtttatatgattgtcaaggaaaatttaagtgacgatcaaattttacgtgaatttttgtattcataa

SEQ ID NO: 11 - protein, 1115 aa, Unknown
  Saccharomyces sp.
MRLLRRNMLVLTLLVCVFSSIISCSIPLSSRTSRRQIVEDEVASTKKLNFNYGVDKNINSPIPAPRTTEGLPNMKLSSYPTPNLLNTADNRRANKKGRRAANSISVPYLENRSLNELSLSDILIAADVEGGLHAVDRRNGHIIWSIEPENFQPLIEIQEPSRLETYETLIIEPFGDGNIYYFNAHQGLQKLPLSIRQLVSTSPLHLKTNIVVNDSGKIVEDEKVYTGSMRTIMYTINMLNGEIISAFGPGSKNGYFGSQSVDCSPEEKIKLQECENMIVIGKTIFELGIHSYDGASYNVTYSTWQQNVLDVPLALQNTFSKDGMCIAPFRDKSLLASDLDFRIARWVSPTFPGIIVGLFDVFNDLRTNENILVPHPFNPGDHESISSNKVYLDQTSNLSWFALSSQNFPSLVESAPISRYASSDRWRVSSIFEDETLFKNAIMGVHQIYNNEYDHLYENYEKTNSLDTTHKYPPLMIDSSVDTTDLHQNNEMNSLKEYMSPEDLEAYRKKIHEQISRELDEKNQNSLLLKFGSLVYRIIETGVFLLLFLIFCAILQRFKILPPLYVLLSKIGFMPEKEIPIVESKSLNCPSSSENVTKPFDMKSGKQVVFEGAVNDGSLKSEKDNDDADEDDEKSLDLTTEKKKRKRGSRGGKKGRKSRIANIPNFEQSLKNLVVSEKILGYGSSGTVVFQGSFQGRPVAVKRMLIDFCDIALMEIKLLTESDDHPNVIRYYCSETTDRFLYIALELCNLNLQDLVESKNVSDENLKLQKEYNPISLLRQIASGVAHLHSLKIIHRDLKPQNILVSTSSRFTADQQTGAENLRILISDFGLCKKLDSGQSSFRTNLNNPSGTSGWRAPELLEESNNLQCQVETEHSSSRHTVVSSDSFYDPFTKRRLTRSIDIFSMGCVFYYILSKGKHPFGDKYSRESNIIRGIFSLDEMKCLHDRSLIAEATDLISQMIDHDPLKRPTAMKVLRHPLFWPKSKKLEFLLKVSDRLEIENRDPPSALLMKFDAGSDFVIPSGDWTVKFDKTFMDNLERYRKYHSSKLMDLLRALRNKYHHFMDLPEDIAELMGPVPDGFYDYFTKRFPNLLIGVYMIVKENLSDDQILREFLYS

SEQ ID NO: 12 - DNA, 2865 bp, Unknown
  Saccharomyces sp.
atggtccttttgaaatggctcgtatgccaattggtcttctttaccgctttttcgcatgcgtttaccgactatctattaaagaagtgtgcgcaatctgggttttgccatagaaacagggtttatgcagaaaatattgccaaatctcatcactgctattacaaagtggacgccgagtctattgcacacgatcctttagagaatgtgcttcatgctaccataattaaaactataccaagattggagggcgatgatatagccgttcagttcccattctctctctcttttttacaggatcactcagtaaggttcactataaatgagaaagagagaatgccaaccaacagcagcggtttgttgatctcttcacaacggttcaatgagacctggaagtacgcattcgacaagaaatttcaagaggaggcgaacaggaccagtattccacaattccacttccttaagcaaaaacaaactgtgaactcattctggtcgaaaatatcttcatttttgtcactttcaaactccactgcagacacatttcatcttcgaaacggtgatgtatccgtagaaatctttgctgaaccttttcaattgaaagtttactggcaaaatgcgctgaaacttattgtaaacgagcaaaatttcctgaacattgaacatcatagaactaagcaggaaaacttcgcacacgtgctgccagaagaaacaactttcaacatgtttaaggacaatttcttgtattcaaagcatgactctatgcctttggggcctgaatcggttgcgctagatttctctttcatgggttctactaatgtctacggtataccggaacatgcgacgtcgctaaggctgatggacacttcaggtggaaaggaaccctacaggcttttcaacgttgatgtctttgagtacaacatcggtaccagccaaccaatgtacggttcgatcccattcatgttttcatcttcgtccacatctatcttttgggtcaatgcagctgacacttgggtagacataaagtatgacaccagtaaaaataaaacgatgactcattggatctccgaaaatggtgtcatagatgtagtcatgtccctggggccagatattccaactatcattgacaaatttaccgatttgactggtagaccctttttaccgcccatttcctctatagggtaccatcaatgtagatggaattataatgatgagatggacgttctcacagtggactctcagatggatgctcatatgattccttacgattttatttggttggacttggagtatacgaacgacaaaaaatattttacttggaagcagcactcctttcccaatccaaaaaggctgttatccaaattaaaaaagttgggtagaaatcttgtcgtactaatcgatcctcatttaaagaaagattatgaaatcagtgacagggtaattaatgaaaatgtagcagtcaaggatcacaatggaaatgactatgtaggtcattgctggccaggtaattctatatggattgataccataagcaaatatggccaaaagatttggaagtcctttttcgaacggtttatggatctgccggctgatttaactaatttattcatttggaatgatatgaacgagccttcgattttcgatggcccagagaccacagctccaaaagatttgattcacgacaattacattgaggaaagatccgtccataacatatatggtctatcagtgcatgaagctacttacgacgcaataaaatcgatttattcaccatccgataagcgtcctttccttctaacaagggctttttttgccggctctcaacgtactgctgccacatggactggtgacaatgtggccaattgggattacttaaagatttccattcctatggttctgtcaaacaacattgctggtatgccatttataggagccgacatagctggctttgctgaggatcctacacctgaattgattgcacgttggtaccaagcgggcttatggtacccattttttagagcacacgcccatatagacaccaagagaagagaaccatacttattcaatgaacctttgaagtcgatagtacgtgatattatccaattgagatatttcctgctacctaccttatacaccatgtttcataaatcaagtgtcactggatttccgataatgaatccaatgtttattgaacaccctgaatttgctgaattgtatcatatcgataaccaattttactggagtaattcaggtctattagtcaaacctgtcacggagcctggtcaatcagaaacggaaatggttttcccacccggtatattctatgaattcgcatctttacactcttttataaacaatggtactgatttgatagaaaagaatatttctgcaccattggataaaattccattatttattgaaggcggtcacattatcactatgaaagataagtatagaagatcttcaatgttaatgaaaaacgatccatatgtaatagttatagcccctgataccgagggacgagccgttggagatctttatgttgatgatggagaaacttttggctaccaaagaggtgagtacgtagaaactcagttcattttcgaaaacaataccttaaaaaatgttcgaagtcatattcccgagaatttgacaggcattcaccacaatactttgaggaataccaatattgaaaaaatcattatcgcaaagaataatttacaacacaacataacgttgaaagacagtattaaagtcaaaaaaaatggcgaagaaagttcattgccgactagatcgtcatatgagaatgataataagatcaccattcttaacctatcgcttgacataactgaagattgggaagttattttttga

SEQ ID NO: 13 - protein, 954 aa, Unknown
  Saccharomyces sp.
MVLLKWLVCQLVFFTAFSHAFTDYLLKKCAQSGFCHRNRVYAENIAKSHHCYYKVDAESIAHDPLENVLHATIIKTIPRLEGDDIAVQFPFSLSFLQDHSVRFTINEKERMPTNSSGLLISSQRFNETWKYAFDKKFQEEANRTSIPQFHFLKQKQTVNSFWSKISSFLSLSNSTADTFHLRNGDVSVEIFAEPFQLKVYWQNALKLIVNEQNFLNIEHHRTKQENFAHVLPEETTFNMFKDNFLYSKHDSMPLGPESVALDFSFMGSTNVYGIPEHATSLRLMDTSGGKEPYRLFNVDVFEYNIGTSQPMYGSIPFMFSSSSTSIFWVNAADTWVDIKYDTSKNKTMTHWISENGVIDVVMSLGPDIPTIIDKFTDLTGRPFLPPISSIGYHQCRWNYNDEMDVLTVDSQMDAHMIPYDFIWLDLEYTNDKKYFTWKQHSFPNPKRLLSKLKKLGRNLVVLIDPHLKKDYEISDRVINENVAVKDHNGNDYVGHCWPGNSIWIDTISKYGQKIWKSFFERFMDLPADLTNLFIWNDMNEPSIFDGPETTAPKDLIHDNYIEERSVHNIYGLSVHEATYDAIKSIYSPSDKRPFLLTRAFFAGSQRTAATWTGDNVANWDYLKISIPMVLSNNIAGMPFIGADIAGFAEDPTPELIARWYQAGLWYPFFRAHAHIDTKRREPYLFNEPLKSIVRDIIQLRYFLLPTLYTMFHKSSVTGFPIMNPMFIEHPEFAELYHIDNQFYWSNSGLLVKPVTEPGQSETEMVFPPGIFYEFASLHSFINNGTDLIEKNISAPLDKIPLFIEGGHIITMKDKYRRSSMLMKNDPYVIVIAPDTEGRAVGDLYVDDGETFGYQRGEYVETQFIFENNTLKNVRSHIPENLTGIHHNTLRNTNIEKIIIAKNNLQHNITLKDSIKVKKNGEESSLPTRSSYENDNKITILNLSLDITEDWEVIF

SEQ ID NO: 14 - DNA, 1218 bp, Unknown
  Saccharomyces sp.
atgttcagcttgaaagcattattgccattggccttgttgttggtcagcgccaaccaagttgctgcaaaagtccacaaggctaaaatttataaacacgagttgtccgatgagatgaaagaagtcactttcgagcaacatttagctcatttaggccaaaagtacttgactcaatttgagaaagctaaccccgaagttgttttttctagggagcatcctttcttcactgaaggtggtcacgatgttccattgacaaattacttgaacgcacaatattacactgacattactttgggtactccacctcaaaacttcaaggttattttggatactggttcttcaaacctttgggttccaagtaacgaatgtggttccttggcttgtttcctacattctaaatacgatcatgaagcttcatcaagctacaaagctaatggtactgaatttgccattcaatatggtactggttctttggaaggttacatttctcaagacactttgtccatcggggatttgaccattccaaaacaagacttcgctgaggctaccagcgagccgggcttaacatttgcatttggcaagttcgatggtattttgggtttgggttacgataccatttctgttgataaggtggtccctccattttacaacgccattcaacaagatttgttggacgaaaagagatttgccttttatttgggagacacttcaaaggatactgaaaatggcggtgaagccacctttggtggtattgacgagtctaagttcaagggcgatatcacttggttacctgttcgtcgtaaggcttactgggaagtcaagtttgaaggtatcggtttaggcgacgagtacgccgaattggagagccatggtgccgccatcgatactggtacttctttgattaccttgccatcaggattagctgaaatgattaatgctgaaattggggccaagaagggttggaccggtcaatatactctagactgtaacaccagagacaatctacctgatctaattttcaacttcaatggctacaacttcactattgggccatacgattacacgcttgaagtttcaggctcctgtatctctgcaattacaccaatggatttcccagaacctgttggcccactggccatcgttggtgatgccttcttgcgtaaatactattctatttacgatttgggcaacaatgcggttggtttggccaaagcaatttga

SEQ ID NO: 15 - protein, 405 aa, Unknown
  Saccharomyces sp.
MFSLKALLPLALLLVSANQVAAKVHKAKIYKHELSDEMKEVTFEQHLAHLGQKYLTQFEKANPEVVFSREHPFFTEGGHDVPLTNYLNAQYYTDITLGTPPQNFKVILDTGSSNLWVPSNECGSLACFLHSKYDHEASSSYKANGTEFAIQYGTGSLEGYISQDTLSIGDLTIPKQDFAEATSEPGLTFAFGKFDGILGLGYDTISVDKVVPPFYNAIQQDLLDEKRFAFYLGDTSKDTENGGEATFGGIDESKFKGDITWLPVRRKAYWEVKFEGIGLGDEYAELESHGAAIDTGTSLITLPSGLAEMINAEIGAKKGWTGQYTLDCNTRDNLPDLIFNFNGYNFTIGPYDYTLEVSGSCISAITPMDFPEPVGPLAIVGDAFLRKYYSIYDLGNNAVGLAKAI

SEQ ID NO: 16 - DNA, 1197 bp, Artificial Sequence
  Geranyl pyrophosphate olivetolic acid geranyltransferase CsPT4 nucleotide sequence (GOT) Codon optimized
atgggtttatctttggtctgcaccttctcctttcaaactaactaccacactttattgaatccacataataagaatcctaagaactctttattgtcctaccaacacccaaagactcctattatcaagtcctcttacgataacttcccatctaagtactgtttgactaagaatttccatttgttgggtttgaattctcacaacagaatttcctcccaatcccgttctattagagccggttctgatcaaatcgaaggttcccctcatcatgagtccgataactccattgctactaaaattttaaatttcggtcatacttgttggaagttgcaacgtccttacgttgtcaagggtatgatctctattgcttgtggtttgttcggtagagaattgtttaacaacagacacttgttctcttggggtttgatgtggaaagctttcttcgctttggtcccaattttgtctttcaatttcttcgccgccatcatgaaccaaatctacgatgttgatatcgaccgtatcaacaagccagacttacctttagtttccggtgaaatgtccattgaaactgcttggatcttgtctatcattgttgccttgactggtttaattgttactattaagttgaagtccgctccattgtttgtcttcatctacatcttcggtatcttcgctggtttcgcttactccgtcccacctattagatggaaacaatatccttttaccaatttcttgatcactatttcctctcatgttggtttggctttcacttcttactctgccaccacttctgctttaggtttgcctttcgtttggcgtcctgccttctctttcattattgctttcatgactgtcatgggtatgactattgcctttgctaaagacatttctgatatcgaaggtgatgctaagtacggtgtctctaccgttgctaccaagttaggtgctagaaatatgacttttgttgtttctggtgtcttattgttgaactacttggtttctatctctattggtatcatttggccacaagttttcaagtctaacattatgatcttgtctcatgctattttggctttctgtttgatctttcaaactcgtgaattagccttagccaattatgcctctgccccatcccgtcaatttttcgaattcatctggttgttatactatgccgaatacttcgtttacgtcttcatttaa

SEQ ID NO: 17 - protein, 398 aa, Cannibis sativa
MGLSLVCTFSFQTNYHTLLNPHNKNPKNSLLSYQHPKTPIIKSSYDNFPSKYCLTKNFHLLGLNSHNRISSQSRSIRAGSDQIEGSPHHESDNSIATKILNFGHTCWKLQRPYVVKGMISIACGLFGRELFNNRHLFSWGLMWKAFFALVPILSFNFFAAIMNQIYDVDIDRINKPDLPLVSGEMSIETAWILSIIVALTGLIVTIKLKSAPLFVFIYIFGIFAGFAYSVPPIRWKQYPFTNFLITISSHVGLAFTSYSATTSALGLPFVWRPAFSFIIAFMTVMGMTIAFAKDISDIEGDAKYGVSTVATKLGARNMTFVVSGVLLLNYLVSISIGIIWPQVFKSNIMILSHAILAFCLIFQTRELALANYASAPSRQFFEFIWLLYYAEYFVYVFI

SEQ ID NO: 18 - DNA, 1158 bp, Artificial Sequence
  Tetraketide synthase (TKS) nucleotide sequence Codon optimized
atgaaccatttaagagctgagggtccagcttccgtcttggctatcggtactgctaatccagagaacattttattacaagatgagtttccagattactatttccgtgttactaagtccgagcatatgacccaattgaaagaaaagttccgtaaaatctgtgataaatctatgattagaaaaagaaactgctttttaaacgaagaacacttgaagcaaaacccaagattagttgaacacgagatgcaaaccttggacgctagacaagatatgttggttgtcgaggttcctaaattgggtaaagacgcctgtgctaaagctatcaaagagtggggtcaacctaagtccaagatcactcacttaatcttcacttccgcttccaccactgacatgcctggtgctgattaccactgtgccaagttgttgggtttgtctccttctgtcaagagagttatgatgtaccaattaggttgttacggtggtggtactgtcttaagaattgctaaggacatcgctgaaaacaacaaaggtgctagagttttagccgtttgttgtgacatcatggcttgtttatttcgtggtccatctgaatctgacttggagttgttggttggtcaagctatttttggtgatggtgccgctgccgtcatcgttggtgctgagccagatgaatccgttggtgaaagaccaattttcgaattagtctctactggtcaaactattttgccaaactccgagggtactatcggtggtcatattcgtgaagccggtttaatctttgatttgcacaaagacgttccaatgttgatctctaacaacatcgaaaagtgtttaattgaggcttttactccaattggtatctctgactggaactctatcttctggatcactcatccaggtggtaaggctatcttggacaaggttgaagaaaaattacatttaaagtccgataaattcgtcgattctcgtcatgttttgtctgaacacggtaacatgtcttcctccactgtcttgtttgttatggatgaattacgtaagagatctttggaggagggtaagtctactactggtgatggtttcgaatggggtgttttgttcggtttcggtcctggtttgactgttgaacgtgttgttgttagatctgttccaattaagtactag

SEQ ID NO: 19 - protein, 385 aa, Cannabis sativa
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 20 - DNA, 306 bp, Artificial Sequence
  Olivetolic acid cyclase (OAC) nucleotide sequence Codon optimized
atggccgtcaaacacttgatcgtcttaaaattcaaggatgaaattactgaagctcaaaaagaagagttcttcaaaacctatgtcaatttagtcaacattattcctgctatgaaggacgtttactggggtaaggatgtcacccaaaagaacaaggaagaaggttacactcacattgttgaagtcactttcgaatctgttgaaactatccaagattatattatccacccagctcatgtcggttttggtgatgtttacagatctttttgggaaaaattgttgatctttgactatactccaagaaaataa

SEQ ID NO: 21 - protein, 101 aa, Cannabis sativa
MAVKHLIVLKFKDEITEAQKEEFFKTYVNLVNIIPAMKDVYWGKDVTQKNKEEGYTHIVEVTFESVETIQDYIIHPAHVGFGDVYRSFWEKLLIFDYTPRK

SEQ ID NO: 22 - DNA, 2163 bp, Artificial Sequence
  Acyl-activating enzyme Cs_AAE1 nucleotide sequence Codon optimized
atgggtaagaattacaagtccttagactctgttgttgcttctgactttattgctttaggtattacttccgaagttgctgaaaccttacacggtagattggctgaaattgtttgcaactacggtgctgctacccctcaaacttggattaacattgctaatcatattttgtctccagatttgccattttctttacaccaaatgttgttctacggttgttacaaggatttcggtcctgctcctccagcttggattcctgatccagaaaaagtcaaatctactaacttgggtgctttgttggaaaagagaggtaaggagtttttgggtgttaagtacaaggacccaatttcttctttctctcacttccaagaattctctgttagaaaccctgaagtttactggagaactgttttgatggatgagatgaagatttctttttctaaggacccagagtgtatcttaagaagagacgacattaacaatccaggtggttctgagtggttaccaggtggttacttgaactctgccaaaaattgcttgaacgttaactctaacaagaaattgaatgacactatgattgtctggagagatgagggtaacgatgatttgcctttgaataaattgactttggatcaattgagaaaaagagtctggttggttggttacgctttggaagaaatgggtttagaaaaaggttgtgctatcgccatcgatatgcctatgcacgttgatgctgttgttatttatttggctattgttttagctggttatgttgttgtttccatcgccgactccttctctgctccagaaatctccaccagattgagattgtctaaagccaaagccattttcacccaagaccacatcattagaggtaagaagcgtattccattgtattctcgtgttgttgaagctaaatctcctatggctatcgtcatcccatgctctggttctaacatcggtgctgaattaagagacggtgatatttcttgggactactttttagaaagagctaaagaattcaaaaactgcgagtttactgctagagaacaacctgtcgacgcttatactaatattttattctcttctggtactactggtgaacctaaggctattccatggacccaagctactcctttgaaagccgctgctgatggttggtcccatttagacatcagaaaaggtgatgtcatcgtctggccaactaacttaggttggatgatgggtccatggttagtctacgcttctttgttgaatggtgcctctatcgccttatataatggttcccctttagtctctggttttgctaaattcgttcaagatgctaaggttaccatgttaggtgttgtcccttctatcgttagatcttggaaatctactaactgtgtttctggttacgactggtccactattcgttgtttctcttcttctggtgaagcttccaatgtcgatgagtacttatggttaatgggtcgtgctaactacaagccagtcatcgaaatgtgcggtggtactgaaattggtggtgctttttccgctggttcttttttacaagcccaatccttgtcttccttctcctctcaatgtatgggttgtactttatatatcttagataagaatggttaccctatgcctaaaaacaagccaggtattggtgaattagctttgggtcctgttatgtttggtgcttctaaaaccttgttaaatggtaatcatcacgacgtttacttcaaaggtatgcctactttgaacggtgaggttttgagacgtcatggtgatattttcgaattaacttccaacggttattatcacgctcacggtagagctgatgatactatgaacattggtggtattaagatctcttccatcgaaattgagagagtttgtaacgaggttgacgatcgtgttttcgaaactactgctattggtgtccctcctttaggtggtggtccagaacaattggttatctttttcgtcttgaaggactccaacgacaccactatcgacttaaaccaattaagattgtctttcaacttgggtttgcaaaagaagttgaatccattatttaaggttactcgtgtcgttccattgtcctccttgccaagaactgctaccaacaagattatgcgtagagtcttgagacaacaattctctcactttgagtaa

SEQ ID NO: 23 - protein, 720 aa, Cannabis sativa
MGKNYKSLDSVVASDFIALGITSEVAETLHGRLAEIVCNYGAATPQTWINIANHILSPDLPFSLHQMLFYGCYKDFGPAPPAWIPDPEKVKSTNLGALLEKRGKEFLGVKYKDPISSFSHFQEFSVRNPEVYWRTVLMDEMKISFSKDPECILRRDDINNPGGSEWLPGGYLNSAKNCLNVNSNKKLNDTMIVWRDEGNDDLPLNKLTLDQLRKRVWLVGYALEEMGLEKGCAIAIDMPMHVDAVVIYLAIVLAGYVVVSIADSFSAPEISTRLRLSKAKAIFTQDHIIRGKKRIPLYSRVVEAKSPMAIVIPCSGSNIGAELRDGDISWDYFLERAKEFKNCEFTAREQPVDAYTNILFSSGTTGEPKAIPWTQATPLKAAADGWSHLDIRKGDVIVWPTNLGWMMGPWLVYASLLNGASIALYNGSPLVSGFAKFVQDAKVTMLGVVPSIVRSWKSTNCVSGYDWSTIRCFSSSGEASNVDEYLWLMGRANYKPVIEMCGGTEIGGAFSAGSFLQAQSLSSFSSQCMGCTLYILDKNGYPMPKNKPGIGELALGPVMFGASKTLLNGNHHDVYFKGMPTLNGEVLRRHGDIFELTSNGYYHAHGRADDTMNIGGIKISSIEIERVCNEVDDRVFETTAIGVPPLGGGPEQLVIFFVLKDSNDTTIDLNQLRLSFNLGLQKKLNPLFKVTRVVPLSSLPRTATNKIMRRVLRQQFSHFE

SEQ ID NO: 24 - DNA, 867 bp, Unknown
  Saccharomyces sp.
atgactgccgacaacaatagtatgccccatggtgcagtatctagttacgccaaattagtgcaaaaccaaacacctgaagacattttggaagagtttcctgaaattattccattacaacaaagacctaatacccgatctagtgagacgtcaaatgacgaaagcggagaaacatgtttttctggtcatgatgaggagcaaattaagttaatgaatgaaaattgtattgttttggattgggacgataatgctattggtgccggtaccaagaaagtttgtcatttaatggaaaatattgaaaagggtttactacatcgtgcattctccgtctttattttcaatgaacaaggtgaattacttttacaacaaagagccactgaaaaaataactttccctgatctttggactaacacatgctgctctcatccactatgtattgatgacgaattaggtttgaagggtaagctagacgataagattaagggcgctattactgcggcggtgagaaaactagatcatgaattaggtattccagaagatgaaactaagacaaggggtaagtttcactttttaaacagaatccattacatggcaccaagcaatgaaccatggggtgaacatgaaattgattacatcctattttataagatcaacgctaaagaaaacttgactgtcaacccaaacgtcaatgaagttagagacttcaaatgggtttcaccaaatgatttgaaaactatgtttgctgacccaagttacaagtttacgccttggtttaagattatttgcgagaattacttattcaactggtgggagcaattagatgacctttctgaagtggaaaatgacaggcaaattcatagaatgctataa

SEQ ID NO: 25 - protein, 288 aa, Unknown
  Saccharomyces sp.
MTADNNSMPHGAVSSYAKLVQNQTPEDILEEFPEIIPLQQRPNTRSSETSNDESGETCFSGHDEEQIKLMNENCIVLDWDDNAIGAGTKKVCHLMENIEKGLLHRAFSVFIFNEQGELLLQQRATEKITFPDLWTNTCCSHPLCIDDELGLKGKLDDKIKGAITAAVRKLDHELGIPEDETKTRGKFHFLNRIHYMAPSNEPWGEHEIDYILFYKINAKENLTVNPNVNEVRDFKWVSPNDLKTMFADPSYKFTPWFKIICENYLFNWWEQLDDLSEVENDRQIHRML

SEQ ID NO: 26 - DNA, 1575 bp, Artificial Sequence
  Truncated 3-hydroxy-3-methyl-glutaryl-CoA reductase (tHMG1, tHMGR)
atgcaattggtgaagactgaagtcaccaagaagtcttttactgctcctgtacaaaaggcttctacaccagttttaaccaataaaacagtcatttctggatcgaaagtcaaaagtttatcatctgcgcaatcgagctcatcaggaccttcatcatctagtgaggaagatgattcccgcgatattgaaagcttggataagaaaatacgtcctttagaagaattagaagcattattaagtagtggaaatacaaaacaattgaagaacaaagaggtcgctgccttggttattcacggtaagttacctttgtacgctttggagaaaaaattaggtgatactacgagagcggttgcggtacgtaggaaggctctttcaattttggcagaagctcctgtattagcatctgatcgtttaccatataaaaattatgactacgaccgcgtatttggcgcttgttgtgaaaatgttataggttacatgcctttgcccgttggtgttataggccccttggttatcgatggtacatcttatcatataccaatggcaactacagagggttgtttggtagcttctgccatgcgtggctgtaaggcaatcaatgctggcggtggtgcaacaactgttttaactaaggatggtatgacaagaggcccagtagtccgtttcccaactttgaaaagatctggtgcctgtaagatatggttagactcagaagagggacaaaacgcaattaaaaaagcttttaactctacatcaagatttgcacgtctgcaacatattcaaacttgtctagcaggagatttactcttcatgagatttagaacaactactggtgacgcaatgggtatgaatatgatttctaagggtgtcgaatactcattaaagcaaatggtagaagagtatggctgggaagatatggaggttgtctccgtttctggtaactactgtaccgacaaaaaaccagctgccatcaactggatcgaaggtcgtggtaagagtgtcgtcgcagaagctactattcctggtgatgttgtcagaaaagtgttaaaaagtgatgtttccgcattggttgagttgaacattgctaagaatttggttggatctgcaatggctgggtctgttggtggatttaacgcacatgcagctaatttagtgacagctgttttcttggcattaggacaagatcctgcacaaaatgtcgaaagttccaactgtataacattgatgaaagaagtggacggtgatttgagaatttccgtatccatgccatccatcgaagtaggtaccatcggtggtggtactgttctagaaccacaaggtgccatgttggacttattaggtgtaagaggcccacatgctaccgctcctggtaccaacgcacgtcaattagcaagaatagttgcctgtgccgtcttggcaggtgaattatccttatgtgctgccctagcagccggccatttggttcaaagtcatatgacccacaacaggaaacctgctgaaccaacaaaacctaacaatttggacgccactgatataaatcgtttgaaagatgggtccgtcacctgcattaaatcctaa

SEQ ID NO: 27 - protein, 524 aa, Artificial Sequence
  Truncated 3-hydroxy-3-methyl-glutaryl-CoA reductase (Sc_tHMG1, tHMGR)
MQLVKTEVTKKSFTAPVQKASTPVLTNKTVISGSKVKSLSSAQSSSSGPSSSSEEDDSRDIESLDKKIRPLEELEALLSSGNTKQLKNKEVAALVIHGKLPLYALEKKLGDTTRAVAVRRKALSILAEAPVLASDRLPYKNYDYDRVFGACCENVIGYMPLPVGVIGPLVIDGTSYHIPMATTEGCLVASAMRGCKAINAGGGATTVLTKDGMTRGPVVRFPTLKRSGACKIWLDSEEGQNAIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVRKVLKSDVSALVELNIAKNLVGSAMAGSVGGFNAHAANLVTAVFLALGQDPAQNVESSNCITLMKEVDGDLRISVSMPSIEVGTIGGGTVLEPQGAMLDLLGVRGPHATAPGTNARQLARIVACAVLAGELSLCAALAAGHLVQSHMTHNRKPAEPTKPNNLDATDINRLKDGSVTCIKS

SEQ ID NO: 28 - DNA, 1387 bp, Unknown
  Saccharomyces sp.
atgactgaactaaaaaaacaaaagaccgctgaacaaaaaaccagacctcaaaatgtcggtattaaaggtatccaaatttacatcccaactcaatgtgtcaaccaatctgagctagagaaatttgatggcgtttctcaaggtaaatacacaattggtctgggccaaaccaacatgtcttttgtcaatgacagagaagatatctactcgatgtccctaactgttttgtctaagttgatcaagagttacaacatcgacaccaacaaaattggtagattagaagtcggtactgaaactctgattgacaagtccaagtctgtcaagtctgtcttgatgcaattgtttggtgaaaacactgacgtcgaaggtattgacacgcttaatgcctgttacggtggtaccaacgcgttgttcaactctttgaactggattgaatctaacgcatgggatggtagagacgccattgtagtttgcggtgatattgccatctacgataagggtgccgcaagaccaaccggtggtgccggtactgttgctatgtggatcggtcctgatgctccaattgtatttgactctgtaagagcttcttacatggaacacgcctacgatttttacaagccagatttcaccagcgaatatccttacgtcgatggtcatttttcattaacttgttacgtcaaggctcttgatcaagtttacaagagttattccaagaaggctatttctaaagggttggttagcgatcccgctggttcggatgctttgaacgttttgaaatatttcgactacaacgttttccatgttccaacctgtaaattggtcacaaaatcatacggtagattactatataacgatttcagagccaatcctcaattgttcccagaagttgacgccgaattagctactcgcgattatgacgaatctttaaccgataagaacattgaaaaaacttttgttaatgttgctaagccattccacaaagagagagttgcccaatctttgattgttccaacaaacacaggtaacatgtacaccgcatctgtttatgccgcctttgcatctctattaaactatgttggatctgacgacttacaaggcaagcgtgttggtttattttcttacggttccggtttagctgcatctctatattcttgcaaaattgttggtgacgtccaacatattatcaaggaattagatattactaacaaattagccaagagaatcaccgaaactccaaaggattacgaagctgccatcgaattgagagaaaatgcccatttgaagaagaacttcaaacctcaaggttccattgagcatttgcaaagtggtgtttactacttgaccaacatcgatgacaaatttagaagatcttacgatgttaaaaaataat

SEQ ID NO: 29 - protein, 461 aa, Unknown
  Saccharomyces sp.
MTELKKQKTAEQKTRPQNVGIKGIQIYIPTQCVNQSELEKFDGVSQGKYTIGLGQTNMSFVNDREDIYSMSLTVLSKLIKSYNIDTNKIGRLEVGTETLIDKSKSVKSVLMQLFGENTDVEGIDTLNACYGGTNALFNSLNWIESNAWDGRDAIVVCGDIAIYDKGAARPTGGAGTVAMWIGPDAPIVFDSVRASYMEHAYDFYKPDFTSEYPYVDGHFSLTCYVKALDQVYKSYSKKAISKGLVSDPAGSDALNVLKYFDYNVFHVPTCKLVTKSYGRLLYNDFRANPQLFPEVDAELATRDYDESLTDKNIEKTFVNVAKPFHKERVAQSLIVPTNTGNMYTASVYAAFASLLNYVGSDDLQGKRVGLFSYGSGLAASLYSCKIVGDVQHIIKELDITNKLAKRITETPKDYEAAIELRENAHLKKNFKPQGSIEHLQSGVYYLTNIDDKFRRSYDVKK

SEQ ID NO: 30 - DNA, 1197 bp, Saccharomyces cerevisiae
atgtctcagaacgtttacattgtatcgactgccagaaccccaattggttcattccagggttctctatcctccaagacagcagtggaattgggtgctgttgctttaaaaggcgccttggctaaggttccagaattggatgcatccaaggattttgacgaaattatttttggtaacgttctttctgccaatttgggccaagctccggccagacaagttgctttggctgccggtttgagtaatcatatcgttgcaagcacagttaacaaggtctgtgcatccgctatgaaggcaatcattttgggtgctcaatccatcaaatgtggtaatgctgatgttgtcgtagctggtggttgtgaatctatgactaacgcaccatactacatgccagcagcccgtgcgggtgccaaatttggccaaactgttcttgttgatggtgtcgaaagagatgggttgaacgatgcgtacgatggtctagccatgggtgtacacgcagaaaagtgtgcccgtgattgggatattactagagaacaacaagacaattttgccatcgaatcctaccaaaaatctcaaaaatctcaaaaggaaggtaaattcgacaatgaaattgtacctgttaccattaagggatttagaggtaagcctgatactcaagtcacgaaggacgaggaacctgctagattacacgttgaaaaattgagatctgcaaggactgttttccaaaaagaaaacggtactgttactgccgctaacgcttctccaatcaacgatggtgctgcagccgtcatcttggtttccgaaaaagttttgaaggaaaagaatttgaagcctttggctattatcaaaggttggggtgaggccgctcatcaaccagctgattttacatgggctccatctcttgcagttccaaaggctttgaaacatgctggcatcgaagacatcaattctgttgattactttgaattcaatgaagccttttcggttgtcggtttggtgaacactaagattttgaagctagacccatctaaggttaatgtatatggtggtgctgttgctctaggtcacccattgggttgttctggtgctagagtggttgttacactgctatccatcttacagcaagaaggaggtaagatcggtgttgccgccatttgtaatggtggtggtggtgcttcctctattgtcattgaaaagatatga

SEQ ID NO: 31 - protein, 398 aa, Saccharomyces cerevisiae
MSQNVYIVSTARTPIGSFQGSLSSKTAVELGAVALKGALAKVPELDASKDFDEIIFGNVLSANLGQAPARQVALAAGLSNHIVASTVNKVCASAMKAIILGAQSIKCGNADVVVAGGCESMTNAPYYMPAARAGAKFGQTVLVDGVERDGLNDAYDGLAMGVHAEKCARDWDITREQQDNFAIESYQKSQKSQKEGKFDNEIVPVTIKGFRGKPDTQVTKDEEPARLHVEKLRSARTVFQKENGTVTAANASPINDGAAAVILVSEKVLKEKNLKPLAIIKGWGEAAHQPADFTWAPSLAVPKALKHAGIEDINSVDYFEFNEAFSVVGLVNTKILKLDPSKVNVYGGAVALGHPLGCSGARVVVTLLSILQQEGGKIGVAAICNGGGGASSIVIEKI

SEQ ID NO: 32 - DNA, 1191 bp, Unknown
  Saccharomyces sp.
atgaccgtttacacagcatccgttaccgcacccgtcaacatcgcaacccttaagtattgggggaaaagggacacgaagttgaatctgcccaccaattcgtccatatcagtgactttatcgcaagatgacctcagaacgttgacctctgcggctactgcacctgagtttgaacgcgacactttgtggttaaatggagaaccacacagcatcgacaatgaaagaactcaaaattgtctgcgcgacctacgccaattaagaaaggaaatggaatcgaaggacgcctcattgcccacattatctcaatggaaactccacattgtctccgaaaataactttcctacagcagctggtttagcttcctccgctgctggctttgctgcattggtctctgcaattgctaagttataccaattaccacagtcaacttcagaaatatctagaatagcaagaaaggggtctggttcagcttgtagatcgttgtttggcggatacgtggcctgggaaatgggaaaagctgaagatggtcatgattccatggcagtacaaatcgcagacagctctgactggcctcagatgaaagcttgtgtcctagttgtcagcgatattaaaaaggatgtgagttccactcagggtatgcaattgaccgtggcaacctccgaactatttaaagaaagaattgaacatgtcgtaccaaagagatttgaagtcatgcgtaaagccattgttgaaaaagatttcgccacctttgcaaaggaaacaatgatggattccaactctttccatgccacatgtttggactctttccctccaatattctacatgaatgacacttccaagcgtatcatcagttggtgccacaccattaatcagttttacggagaaacaatcgttgcatacacgtttgatgcaggtccaaatgctgtgttgtactacttagctgaaaatgagtcgaaactctttgcatttatctataaattgtttggctctgttcctggatgggacaagaaatttactactgagcagcttgaggctttcaaccatcaatttgaatcatctaactttactgcacgtgaattggatcttgagttgcaaaaggatgttgccagagtgattttaactcaagtcggttcaggcccacaagaaacaaacgaatctttgattgacgcaaagactggtctaccaaaggaataa

SEQ ID NO: 33 - protein, 396 aa, Unknown
  Saccharomyces sp.
MTVYTASVTAPVNIATLKYWGKRDTKLNLPTNSSISVTLSQDDLRTLTSAATAPEFERDTLWLNGEPHSIDNERTQNCLRDLRQLRKEMESKDASLPTLSQWKLHIVSENNFPTAAGLASSAAGFAALVSAIAKLYQLPQSTSEISRIARKGSGSACRSLFGGYVAWEMGKAEDGHDSMAVQIADSSDWPQMKACVLVVSDIKKDVSSTQGMQLTVATSELFKERIEHVVPKRFEVMRKAIVEKDFATFAKETMMDSNSFHATCLDSFPPIFYMNDTSKRIISWCHTINQFYGETIVAYTFDAGPNAVLYYLAENESKLFAFIYKLFGSVPGWDKKFTTEQLEAFNHQFESSNFTARELDLELQKDVARVILTQVGSGPQETNESLIDAKTGLPKE

SEQ ID NO: 34 - DNA, 1707 bp, Artificial Sequence
  Pyruvate decarboxylase (Zm_PDC)  Codon optimized
atgtcctacaccgttggtacctacttagctgagcgtttggtccaaatcggtttgaagcaccatttcgccgttgctggtgattacaacttggtcttgttagataatttattattgaacaagaacatggaacaagtctactgctgtaatgaattgaactgtggtttctctgctgaaggttatgctagagctaaaggtgccgctgccgctgttgtcacttactctgttggtgctttgtctgccttcgacgctattggtggtgcttacgccgagaatttacctgttattttaatttctggtgcccctaacaataacgatcatgctgctggtcatgttttacaccacgctttgggtaaaactgactaccattatcaattagagatggccaaaaacatcaccgccgctgccgaggccatttacactccagaagaagccccagccaaaattgatcacgtcatcaaaaccgccttgagagagaaaaaacctgtttacttggaaatcgcctgtaatatcgcctctatgccttgcgccgctcctggtcctgcttccgccttattcaacgatgaggcttctgatgaagcttccttaaacgctgctgttgaggagactttaaagttcatcgctaatagagataaggtcgctgttttagtcggttctaagttgcgtgctgccggtgccgaggaagctgctgttaaattcgccgatgctttaggtggtgctgtcgccaccatggccgccgccaaatcctttttccctgaagaaaacccacactacatcggtacttcttggggtgaagtctcttacccaggtgtcgaaaagactatgaaggaagccgatgccgtcatcgccttggccccagtttttaatgattattccaccactggttggactgatatcccagatcctaaaaagttagttttagccgagcctagatccgttgttgttaacggtattagattcccttccgttcacttgaaggattacttaactagattggctcaaaaggtttccaagaagaccggtgctttggactttttcaaatctttgaacgccggtgagttaaagaaggccgcccctgctgacccatctgctccattggttaacgctgagattgctagacaagtcgaagctttattgaccccaaacactaccgttatcgccgaaactggtgactcttggtttaatgctcaaagaatgaagttaccaaatggtgccagagttgagtacgaaatgcaatggggtcatatcggttggtctgtcccagctgcttttggttatgctgttggtgcccctgagagaagaaacatcttgatggttggtgacggttccttccaattgactgctcaagaagtcgctcaaatggttagattaaaattaccagtcatcatcttcttgatcaataactacggttacactatcgaagtcatgattcacgatggtccttacaataatattaagaactgggactatgctggtttgatggaagtctttaatggtaacggtggttacgattccggtgctggtaagggtttaaaggctaagactggtggtgaattagctgaagccattaaggttgccttggctaacaccgacggtcctactttaatcgaatgtttcattggtagagaggattgtaccgaagagttagttaagtggggtaagagagttgccgctgctaattcccgtaagcctgtcaataaattgttataa

SEQ ID NO: 35 - protein, 568 aa, Zymomonas mobilis
MSYTVGTYLAERLVQIGLKHHFAVAGDYNLVLLDNLLLNKNMEQVYCCNELNCGFSAEGYARAKGAAAAVVTYSVGALSAFDAIGGAYAENLPVILISGAPNNNDHAAGHVLHHALGKTDYHYQLEMAKNITAAAEAIYTPEEAPAKIDHVIKTALREKKPVYLEIACNIASMPCAAPGPASALFNDEASDEASLNAAVEETLKFIANRDKVAVLVGSKLRAAGAEEAAVKFADALGGAVATMAAAKSFFPEENPHYIGTSWGEVSYPGVEKTMKEADAVIALAPVFNDYSTTGWTDIPDPKKLVLAEPRSVVVNGIRFPSVHLKDYLTRLAQKVSKKTGALDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAGKGLKAKTGGELAEAIKVALANTDGPTLIECFIGREDCTEELVKWGKRVAAANSRKPVNKLL

SEQ ID NO: 36 - DNA, 1356 bp, Saccharomyces cerevisiae
atgtcagagttgagagccttcagtgccccagggaaagcgttactagctggtggatatttagttttagatccgaaatatgaagcatttgtagtcggattatcggcaagaatgcatgctgtagcccatccttacggttcattgcaagagtctgataagtttgaagtgcgtgtgaaaagtaaacaatttaaagatggggagtggctgtaccatataagtcctaaaactggcttcattcctgtttcgataggcggatctaagaaccctttcattgaaaaagttatcgctaacgtatttagctactttaagcctaacatggacgactactgcaatagaaacttgttcgttattgatattttctctgatgatgcctaccattctcaggaggacagcgttaccgaacatcgtggcaacagaagattgagttttcattcgcacagaattgaagaagttcccaaaacagggctgggctcctcggcaggtttagtcacagttttaactacagctttggcctccttttttgtatcggacctggaaaataatgtagacaaatatagagaagttattcataatttatcacaagttgctcattgtcaagctcagggtaaaattggaagcgggtttgatgtagcggcggcagcatatggatctatcagatatagaagattcccacccgcattaatctctaatttgccagatattggaagtgctacttacggcagtaaactggcgcatttggttaatgaagaagactggaatataacgattaaaagtaaccatttaccttcgggattaactttatggatgggcgatattaagaatggttcagaaacagtaaaactggtccagaaggtaaaaaattggtatgattcgcatatgccggaaagcttgaaaatatatacagaactcgatcatgcaaattctagatttatggatggactatctaaactagatcgcttacacgagactcatgacgattacagcgatcagatatttgagtctcttgagaggaatgactgtacctgtcaaaagtatcctgagatcacagaagttagagatgcagttgccacaattagacgttcctttagaaaaataactaaagaatctggtgccgatatcgaacctcccgtacaaactagcttattggatgattgccagaccttaaaaggagttcttacttgcttaatacctggtgctggtggttatgacgccattgcagtgattgctaagcaagatgttgatcttagggctcaaaccgctgatgacaaaagattttctaaggttcaatggctggatgtaactcaggctgactggggtgttaggaaagaaaaagatccggaaacttatcttgataaataa

SEQ ID NO: 37 - protein, 451 aa, Saccharomyces cerevisiae
MSELRAFSAPGKALLAGGYLVLDPKYEAFVVGLSARMHAVAHPYGSLQESDKFEVRVKSKQFKDGEWLYHISPKTGFIPVSIGGSKNPFIEKVIANVFSYFKPNMDDYCNRNLFVIDIFSDDAYHSQEDSVTEHRGNRRLSFHSHRIEEVPKTGLGSSAGLVTVLTTALASFFVSDLENNVDKYREVIHNLSQVAHCQAQGKIGSGFDVAAAAYGSIRYRRFPPALISNLPDIGSATYGSKLAHLVNEEDWNITIKSNHLPSGLTLWMGDIKNGSETVKLVQKVKNWYDSHMPESLKIYTELDHANSRFMDGLSKLDRLHETHDDYSDQIFESLERNDCTCQKYPEITEVRDAVATIRRSFRKITKESGADIEPPVQTSLLDDCQTLKGVLTCLIPGAGGYDAIAVIAKQDVDLRAQTADDKRFSKVQWLDVTQADWGVRKEKDPETYLDK

SEQ ID NO: 38 - DNA, 1332 bp, Unknown
  Saccharomyces sp.
atgtcattaccgttcttaacttctgcaccgggaaaggttattatttttggtgaacactctgctgtgtacaacaagcctgccgtcgctgctagtgtgtctgcgttgagaacctacctgctaataagcgagtcatctgcaccagatactattgaattggacttcccggacattagctttaatcataagtggtccatcaatgatttcaatgccatcaccgaggatcaagtaaactcccaaaaattggccaaggctcaacaagccaccgatggcttgtctcaggaactcgttagtcttttggatccgttgttagctcaactatccgaatccttccactaccatgcagcgttttgtttcctgtatatgtttgtttgcctatgcccccatgccaagaatattaagttttctttaaagtctactttacccatcggtgctgggttgggctcaagcgcctctatttctgtatcactggccttagctatggcctacttgggggggttaataggatctaatgacttggaaaagctgtcagaaaacgataagcatatagtgaatcaatgggccttcataggtgaaaagtgtattcacggtaccccttcaggaatagataacgctgtggccacttatggtaatgccctgctatttgaaaaagactcacataatggaacaataaacacaaacaattttaagttcttagatgatttcccagccattccaatgatcctaacctatactagaattccaaggtctacaaaagatcttgttgctcgcgttcgtgtgttggtcaccgagaaatttcctgaagttatgaagccaattctagatgccatgggtgaatgtgccctacaaggcttagagatcatgactaagttaagtaaatgtaaaggcaccgatgacgaggctgtagaaactaataatgaactgtatgaacaactattggaattgataagaataaatcatggactgcttgtctcaatcggtgtttctcatcctggattagaacttattaaaaatctgagcgatgatttgagaattggctccacaaaacttaccggtgctggtggcggcggttgctctttgactttgttacgaagagacattactcaagagcaaattgacagtttcaaaaagaaattgcaagatgattttagttacgagacatttgaaacagacttgggtgggactggctgctgtttgttaagcgcaaaaaatttgaataaagatcttaaaatcaaatccctagtattccaattatttgaaaataaaactaccacaaagcaacaaattgacgatctattattgccaggaaacacgaatttaccatggacttcataa

SEQ ID NO: 39 - protein, 443 aa, Unknown
  Saccharomyces sp.
MSLPFLTSAPGKVIIFGEHSAVYNKPAVAASVSALRTYLLISESSAPDTIELDFPDISFNHKWSINDFNAITEDQVNSQKLAKAQQATDGLSQELVSLLDPLLAQLSESFHYHAAFCFLYMFVCLCPHAKNIKFSLKSTLPIGAGLGSSASISVSLALAMAYLGGLIGSNDLEKLSENDKHIVNQWAFIGEKCIHGTPSGIDNAVATYGNALLFEKDSHNGTINTNNFKFLDDFPAIPMILTYTRIPRSTKDLVARVRVLVTEKFPEVMKPILDAMGECALQGLEIMTKLSKCKGTDDEAVETNNELYEQLLELIRINHGLLVSIGVSHPGLELIKNLSDDLRIGSTKLTGAGGGGCSLTLLRRDITQEQIDSFKKKLQDDFSYETFETDLGGTGCCLLSAKNLNKDLKIKSLVFQLFENKTTTKQQIDDLLLPGNTNLPWTS

SEQ ID NO: 40 - DNA, 1059 bp, Artificial Sequence
  Variant farnesyl pyrophosphate synthase (ERG20mut, F96W, N127W; GPPS) Codon optimized
atggcttctgagaaggagattcgtcgtgagagattcttgaatgtttttcctaaattagtcgaggaattgaacgcttctttgttggcttatggtatgcctaaggaagcttgtgattggtatgctcactccttgaattataatactccaggtggtaaattgaaccgtggtttgtctgttgttgacacttacgctattttatctaacaagaccgtcgagcaattgggtcaagaagagtatgaaaaggtcgctattttaggttggtgtattgaattgttgcaagcttactggttggttgccgatgacatgatggacaagtctattactcgtcgtggtcaaccttgctggtataaggtcccagaggttggtgaaattgctatctgggacgctttcatgttggaagctgctatctataaattgttgaaatcccacttcagaaacgagaaatactacattgacatcaccgagttgttccacgaagtcactttccaaactgagttaggtcaattaatggacttgatcaccgctccagaagacaaagttgacttgtccaagttttccttgaaaaagcactctttcatcgttactttcaagactgcttattactctttctacttaccagttgccttggctatgtacgtcgccggtatcactgacgaaaaggacttgaagcaagctcgtgacgttttgattccattaggtgaatatttccaaatccaagatgactacttagactgttttggtacccctgaacaaatcggtaagatcggtactgatattcaagataacaagtgctcttgggttatcaacaaggctttagagttagcctccgccgaacaacgtaaaactttagatgaaaactacggtaaaaaagactctgttgctgaggccaagtgtaagaagatttttaacgatttaaaaatcgaacaattgtatcacgaatatgaagagtccattgctaaggatttgaaggctaaaatttctcaagttgacgaatcccgtggtttcaaagctgacgttttgactgcttttttaaacaaggtttacaagcgttccaaataa

SEQ ID NO: 41 - protein, 352 aa, Artificial Sequence
  Variant farnesyl pyrophosphate synthase (ERG20mut, F96W, N127W; GPPS)
MASEKEIRRERFLNVFPKLVEELNASLLAYGMPKEACDWYAHSLNYNTPGGKLNRGLSVVDTYAILSNKTVEQLGQEEYEKVAILGWCIELLQAYWLVADDMMDKSITRRGQPCWYKVPEVGEIAIWDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 42 - DNA, 717 bp, Artificial Sequence
  GFP
atgtctaccgcactaacagaaggagctaaactattcgaaaaggagattccttacattacagaattagagggtgatgtcgaaggaatgaaattcattatcaagggcgagggtactggtgacgctactaccggtacgattaaagcaaagtacatctgtacaacaggtgaccttcctgttccgtgggctactctggtgagcactttgtcttatggagttcaatgttttgctaaatacccttcgcacattaaagactttttcaaaagtgcaatgcctgagggctatactcaggagagaacaatatctttcgaaggagatggtgtgtataagactagggctatggtcacgtatgaaagaggatccatctacaatagagtaactttaactggtgaaaacttcaaaaaggacggtcacatccttagaaagaatgttgcctttcaatgcccaccatccatcttgtacattttgccagacacagttaacaatggtatcagagttgagtttaaccaagcttatgacatagagggtgtcaccgaaaagttggttacaaaatgttcacagatgaatcgtcccctggcaggatcagctgccgtccatatcccacgttaccatcatatcacttatcataccaagctgtccaaagatcgtgatgagagaagggatcacatgtgtttggttgaagtggtaaaggccgtggatttggatacttaccaaggttga

SEQ ID NO: 43 - protein, 238 aa, Artificial Sequence
  GFP
MSTALTEGAKLFEKEIPYITELEGDVEGMKFIIKGEGTGDATTGTIKAKYICTTGDLPVPWATLVSTLSYGVQCFAKYPSHIKDFFKSAMPEGYTQERTISFEGDGVYKTRAMVTYERGSIYNRVTLTGENFKKDGHILRKNVAFQCPPSILYILPDTVNNGIRVEFNQAYDIEGVTEKLVTKCSQMNRPLAGSAAVHIPRYHHITYHTKLSKDRDERRDHMCLVEVVKAVDLDTYQG

SEQ ID NO: 44 - protein, 545 aa, Cannabis sativa
MNCSAFSFWFVCKIIFFFLSFHIQISIANPRENFLKCFSKHIPNNVANPKLVYTQHDQLYMSILNSTIQNLRFISDTTPKPLVIVTPSNNSHIQATILCSKKVGLQIRTRSGGHDAEGMSYISQVPFVVVDLRNMHSIKIDVHSQTAWVEAGATLGEVYYWINEKNENLSFPGGYCPTVGVGGHFSGGGYGALMRNYGLAADNIIDAHLVNVDGKVLDRKSMGEDLFWAIRGGGGENFGIIAAWKIKLVAVPSKSTIFSVKKNMEIHGLVKLFNKWQNIAYKYDKDLVLMTHFITKNITDNHGKNKTTVHGYFSSIFHGGVDSLVDLMNKSFPELGIKKTDCKEFSWIDTTIFYSGVVNFNTANFKKEILLDRSAGKKTAFSIKLDYVKKPIPETAMVKILEKLYEEDVGAGMYVLYPYGGIMEEISESAIPFPHRAGIMYELWYTASWEKQEDNEKHINWVRSVYNFTTPYVSQNPRLAYLNYRDLDLGKTNHASPNNYTQARIWGEKYFGKNFNRLVKVKTKVDPNNFFRNEQSIPPLPPHHH

SEQ ID NO: 45 - DNA, 1638 bp, Artificial Sequence
  THCA synthase Codon optimized sequence 1
atgaattgttctgctttctctttctggttcgtttgtaagatcatctttttcttcttatctttccatattcaaatctctatcgctaaccctcgtgagaacttcttgaaatgtttctccaaacatatcccaaacaatgtcgctaaccctaagttagtttacactcaacatgatcaattatatatgtctatcttgaactctaccatccaaaacttgagattcatctccgataccaccccaaaaccattggttattgttaccccatccaacaattctcatattcaagctaccattttgtgctccaaaaaggtcggtttgcaaatccgtactagatctggtggtcacgatgctgaaggtatgtcttacatttcccaagtcccattcgttgttgtcgatttaagaaatatgcactctatcaaaatcgacgttcactctcaaactgcttgggttgaagccggtgccactttaggtgaggtttactactggattaacgaaaagaatgaaaacttatcctttccaggtggttactgtccaactgttggtgttggtggtcacttctctggtggtggttatggtgccttgatgagaaactacggtttagctgctgataatattatcgacgctcacttggttaatgtcgacggtaaggttttggacagaaaatccatgggtgaagatttattctgggccattagaggtggtggtggtgaaaacttcggtatcattgctgcttggaaaattaaattggtcgctgtcccatccaagtctactattttctccgtcaagaaaaacatggaaattcatggtttggttaaattattcaacaagtggcaaaacattgcttacaaatacgacaaagacttagttttgatgacccacttcattactaaaaacattaccgacaaccatggtaaaaataaaactactgttcacggttacttctcttccatttttcatggtggtgtcgactccttggtcgatttaatgaacaaatctttccctgagttgggtatcaagaagaccgactgtaaagaattctcttggatcgacactactattttctactctggtgtcgttaacttcaacaccgctaatttcaagaaggaaattttattagatagatccgctggtaaaaagaccgctttctctatcaaattagactacgttaaaaaaccaatcccagaaaccgctatggtcaaaatcttggaaaaattatatgaagaagacgttggtgccggtatgtacgtcttatatccatatggtggtattatggaagagatctctgaatccgctatcccttttccacacagagccggtattatgtacgaattatggtacactgcttcctgggagaaacaagaagataatgaaaagcacattaactgggttagatctgtttacaacttcactactccatacgtctctcaaaacccaagattagcctacttaaactaccgtgatttggatttaggtaaaactaatcacgcttccccaaacaactacacccaagctagaatttggggtgagaagtactttggtaagaacttcaaccgtttagtcaaggtcaagactaaagttgatccaaacaattttttcagaaacgaacaatctatcccacctttaccaccacaccaccattag

SEQ ID NO: 46 - DNA, 878 bp, Unknown
  Saccharomyces sp.
tgttgtggaaatgtaaagagccccattatcttagcctaaaaaaaccttctctttggaactttcagtaatacgcttaactgctcattgctatattgaagtacggattagaagccgccgagcgggcgacagccctccgacggaagactctcctccgtgcgtcctggtcttcaccggtcgcgttcctgaaacgcagatgtgcctcgcgccgcactgctccgaacaataaagattctacaatactagcttttatggttatgaagaggaaaaattggcagtaacctggccccacaaaccttcaaatcaacgaatcaaattaacaaccataggataataatgcgattagttttttagccttatttctggggtaattaatcagcgaagcgatgatttttgatctattaacagatatataaatgcaaaagctgcataaccactttaactaatactttcaacattttcggtttgtattacttcttattcaaatgtcataaaagtatcaacaaaaaattgttaatatacctctatactttaacgtcaaggagaaaaaactatactcttattaccctatcctatggataaagcaatcttgatgaggataatgatttttttttgaatatacataaatactaccgtttttctgctagattttgtgaagacgtaaataagtacatattactttttaagccaagacaagattaagcattaactttacccttttctcttctaagtttcaatactagttatcactgtttaaaagttatggcgagaacgtcggcggttaaaatatattaccctgaacgtggtgaattgaagttctaggatggtttaaagatttttcctttttgggaaataagtaaacaatatattgctgcctttgc

SEQ ID NO: 47 - DNA, 306 bp, Artificial Sequence
  OAC Y27F variant (OAC) Codon optimized
atggccgtcaaacacttgatcgtcttaaaattcaaggatgaaattactgaagctcaaaaagaagagttcttcaaaaccttcgtcaatttagtcaacattattcctgctatgaaggacgtttactggggtaaggatgtcacccaaaagaacaaggaagaaggttacactcacattgttgaagtcactttcgaatctgttgaaactatccaagattatattatccacccagctcatgtcggttttggtgatgtttacagatctttttgggaaaaattgttgatctttgactatactccaagaaaataa

SEQ ID NO: 48 - protein, 101 aa, Artificial Sequence
  OAC Y27F variant (OAC)
MAVKHLIVLKFKDEITEAQKEEFFKTFVNLVNIIPAMKDVYWGKDVTQKNKEEGYTHIVEVTFESVETIQDYIIHPAHVGFGDVYRSFWEKLLIFDYTPRK

SEQ ID NO: 49 - DNA, 1635 bp, Artificial Sequence
  CBDA Synthase, C12F variant Codon optimized
atgaaatgctccactttctctttctggttcgtttttaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 50 - protein, 544 aa, Artificial Sequence
  CBDA Synthase, C12F variant
MKCSTFSFWFVFKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 51 - DNA, 1635 bp, Artificial Sequence
  CBDA Synthase, F17M variant Codon optimized
atgaaatgctccactttctctttctggttcgtttgtaagattatcttcatgttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 52 - protein, 544 aa, Artificial Sequence
  CBDA Synthase, F17M variant
MKCSTFSFWFVCKIIFMFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 53 - DNA, 1635 bp, Artificial Sequence
  CBDA Synthase, F18T variant Codon optimized
atgaaatgctccactttctctttctggttcgtttgtaagattatcttcttcactttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 54 - protein, 544 aa, Artificial Sequence
  CBDA Synthase, F18T variant
MKCSTFSFWFVCKIIFFTFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 55 - DNA, 1635 bp, Artificial Sequence
  CBDA Synthase, F18W variant Codon optimized
atgaaatgctccactttctctttctggttcgtttgtaagattatcttcttctggttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 56 - protein, 544 aa, Artificial Sequence
  CBDA Synthase, F18W variant
MKCSTFSFWFVCKIIFFWFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 57 - DNA, 1635 bp, Artificial Sequence
  CBDA Synthase, S20G variant Codon optimized
atgaaatgctccactttctctttctggttcgtttgtaagattatcttcttcttctttggtttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 58 - protein, 544 aa, Artificial Sequence
  CBDA Synthase, S20G variant
MKCSTFSFWFVCKIIFFFFGFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 59 - DNA, 1635 bp, Artificial Sequence
  CBDA Synthase, R31Q variant Codon optimized
atgaaatgctccactttctctttctggttcgtttgtaagattatcttcttcttcttttctttcaacatccaaacttccattgccaaccctcaagagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 60 - protein, 544 aa, Artificial Sequence
  CBDA Synthase, R31Q variant
MKCSTFSFWFVCKIIFFFFSFNIQTSIANPQENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 61 - DNA, 1635 bp, Artificial Sequence
  CBDA Synthase, N33K variant Codon optimized
atgaaatgctccactttctctttctggttcgtttgtaagattatcttcttcttcttttctttcaacatccaaacttccattgccaaccctcgtgagaaattcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 62 - protein, 544 aa, Artificial Sequence
  CBDA Synthase, N33K variant
MKCSTFSFWFVCKIIFFFFSFNIQTSIANPREKFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 63 - DNA, 1635 bp, Artificial Sequence
  CBDA Synthase, P43E variant Codon optimized
atgaaatgctccactttctctttctggttcgtttgtaagattatcttcttcttcttttctttcaacatccaaacttccattgccaaccctcgtgagaacttcttgaaatgtttttctcaatatatcgaaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 64 - protein, 544 aa, Artificial Sequence
  CBDA Synthase, P43E variant
MKCSTFSFWFVCKIIFFFFSFNIQTSIANPRENFLKCFSQYIENNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 65 - DNA, 1635 bp, Artificial Sequence
  CBDA Synthase, L49E variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacgaaaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 66 - protein, 544 aa, Artificial Sequence
  CBDA Synthase, L49E variant
MKCSTFSFWFVCKIIFFFFSFNIQTSIANPRENFLKCFSQYIPNNATNEKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 67 - DNA, 1635 bp, Artificial Sequence
  CBDA Synthase, L49K variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacaaaaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 68 - protein, 544 aa, Artificial Sequence
  CBDA Synthase, L49K variant
MKCSTFSFWFVCKIIFFFFSFNIQTSIANPRENFLKCFSQYIPNNATNKKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 69 - DNA, 1635 bp, Artificial Sequence
  CBDA Synthase, L49Q variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaaccaaaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 70 - protein, 544 aa, Artificial Sequence
  CBDA Synthase, L49Q variant
MKCSTFSFWFVCKIIFFFFSFNIQTSIANPRENFLKCFSQYIPNNATNQKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 71 - DNA, 1635 bp, Artificial Sequence
  CBDA Synthase, K50T variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgactttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 72 - protein, 544 aa, Artificial Sequence
  CBDA Synthase, K50T variant
MKCSTFSFWFVCKIIFFFFSFNIQTSIANPRENFLKCFSQYIPNNATNLTLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 73 - DNA, 1635 bp, Artificial Sequence
  CBDA Synthase, L51I variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagattgtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 74 - protein, 544 aa, Artificial Sequence
  CBDA Synthase, L51I variant
MKCSTFSFWFVCKIIFFFFSFNIQTSIANPRENFLKCFSQYIPNNATNLKIVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 75 - DNA, 1635 bp, Artificial Sequence
  CBDA Synthase, Q55E variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactgaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 76 - protein, 544 aa, Artificial Sequence
  CBDA Synthase, Q55E variant
MKCSTFSFWFVCKIIFFFFSFNIQTSIANPRENFLKCFSQYIPNNATNLKLVYTENNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 77 - DNA, 1635 bp, Artificial Sequence
  CBDA Synthase, Q55P variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactccaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 78 - protein, 544 aa, Artificial Sequence
  CBDA Synthase, Q55P variant
MKCSTFSFWFVCKIIFFFFSFNIQTSIANPRENFLKCFSQYIPNNATNLKLVYTPNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 79 - DNA, 1635 bp, Artificial Sequence
  CBDA Synthase, N56E variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaagaaaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 80 - protein, 544 aa, Artificial Sequence
  CBDA Synthase, N56E variant
MKCSTFSFWFVCKIIFFFFSFNIQTSIANPRENFLKCFSQYIPNNATNLKLVYTQENPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 81 - DNA, 1635 bp, Artificial Sequence
  CBDA Synthase, N57D variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacgatccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 82 - protein, 544 aa, Artificial Sequence
  CBDA Synthase, N57D variant
MKCSTFSFWFVCKIIFFFFSFNIQTSIANPRENFLKCFSQYIPNNATNLKLVYTQNDPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 83 - DNA, 1635 bp, Artificial Sequence
  CBDA Synthase, N57E variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacgaaccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 84 - protein, 544 aa, Artificial Sequence
  CBDA Synthase, N57E variant
MKCSTFSFWFVCKIIFFFFSFNIQTSIANPRENFLKCFSQYIPNNATNLKLVYTQNEPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 85 - DNA, 1635 bp, Artificial Sequence
  CBDA Synthase, L59E variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccagaatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 86 - protein, 544 aa, Artificial Sequence
  CBDA Synthase, L59E variant
MKCSTFSFWFVCKIIFFFFSFNIQTSIANPRENFLKCFSQYIPNNATNLKLVYTQNNPEYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 87 - DNA, 1635 bp, Artificial Sequence
  CBDA Synthase, M61H variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatcattctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 88 - protein, 544 aa, Artificial Sequence
  CBDA Synthase, M61H variant
MKCSTFSFWFVCKIIFFFFSFNIQTSIANPRENFLKCFSQYIPNNATNLKLVYTQNNPLYHSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 89 - DNA, 1635 bp, Artificial Sequence
  CBDA Synthase, M61S variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatattcttctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 90 - protein, 544 aa, Artificial Sequence
  CBDA Synthase, M61S variant
MKCSTFSFWFVCKIIFFFFSFNIQTSIANPRENFLKCFSQYIPNNATNLKLVYTQNNPLYSSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 91 - DNA, 1635 bp, Artificial Sequence
  CBDA Synthase, M61W variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatattggtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 92 - protein, 544 aa, Artificial Sequence
  CBDA Synthase, M61W variant
MKCSTFSFWFVCKIIFFFFSFNIQTSIANPRENFLKCFSQYIPNNATNLKLVYTQNNPLYWSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 93 - DNA, 1635 bp, Artificial Sequence
  CBDA Synthase, S62N variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgaatgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 94 - protein, 544 aa, Artificial Sequence
  CBDA Synthase, S62N variant
MKCSTFSFWFVCKIIFFFFSFNIQTSIANPRENFLKCFSQYIPNNATNLKLVYTQNNPLYMNVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 95 - DNA, 1635 bp, Artificial Sequence
  CBDA Synthase, S62Q variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgcaagtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 96 - protein, 544 aa, Artificial Sequence
  CBDA Synthase, S62Q variant
MKCSTFSFWFVCKIIFFFFSFNIQTSIANPRENFLKCFSQYIPNNATNLKLVYTQNNPLYMQVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 97 - DNA, 1635 bp, Artificial Sequence
  CBDA Synthase, V63M variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctatgttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 98 - protein, 544 aa, Artificial Sequence
  CBDA Synthase, V63M variant
MKCSTFSFWFVCKIIFFFFSFNIQTSIANPRENFLKCFSQYIPNNATNLKLVYTQNNPLYMSMLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 99 - DNA, 1635 bp, Artificial Sequence
  CBDA Synthase, S66D variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaacgataccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 100 - protein, 544 aa, Artificial Sequence
  CBDA Synthase, S66D variant
MKCSTFSFWFVCKIIFFFFSFNIQTSIANPRENFLKCFSQYIPNNATNLKLVYTQNNPLYMSVLNDTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 101 - DNA, 1635 bp, Artificial Sequence
  CBDA Synthase, L71A variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacgctcgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 102 - protein, 544 aa, Artificial Sequence
  CBDA Synthase, L71A variant
MKCSTFSFWFVCKIIFFFFSFNIQTSIANPRENFLKCFSQYIPNNATNLKLVYTQNNPLYMSVLNSTIHNARFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 103 - DNA, 1635 bp, Artificial Sequence
  CBDA Synthase, L71H variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaaccatcgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 104 - protein, 544 aa, Artificial Sequence
  CBDA Synthase, L71H variant
MKCSTFSFWFVCKIIFFFFSFNIQTSIANPRENFLKCFSQYIPNNATNLKLVYTQNNPLYMSVLNSTIHNHRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 105 - DNA, 1635 bp, Artificial Sequence
  CBDA Synthase, L71Q variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaaccaacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 106 - protein, 544 aa, Artificial Sequence
  CBDA Synthase, L71Q variant
MKCSTFSFWFVCKIIFFFFSFNIQTSIANPRENFLKCFSQYIPNNATNLKLVYTQNNPLYMSVLNSTIHNQRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 107 - DNA, 1635 bp, Artificial Sequence
  CBDA Synthase, S75D variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcactgatgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 108 - protein, 544 aa, Artificial Sequence
  CBDA Synthase, S75D variant
MKCSTFSFWFVCKIIFFFFSFNIQTSIANPRENFLKCFSQYIPNNATNLKLVYTQNNPLYMSVLNSTIHNLRFTDDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 109 - DNA, 1635 bp, Artificial Sequence
  CBDA Synthase, S75E variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcactgaagatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 110 - protein, 544 aa, Artificial Sequence
  CBDA Synthase, S75E variant
MKCSTFSFWFVCKIIFFFFSFNIQTSIANPRENFLKCFSQYIPNNATNLKLVYTQNNPLYMSVLNSTIHNLRFTEDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 111 - DNA, 1635 bp, Artificial Sequence
  CBDA Synthase, I97V variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccgttttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 112 - protein, 544 aa, Artificial Sequence
  CBDA Synthase, I97V variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTVLCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 113 - DNA, 1635 bp, Artificial Sequence
  CBDA Synthase, L98V variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcgtttgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 114 - protein, 544 aa, Artificial Sequence
  CBDA Synthase, L98V variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTIVCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 115 - DNA, 1635 bp, Artificial Sequence
  CBDA Synthase, S100A variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgtgctaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 116 - protein, 544 aa, Artificial Sequence
  CBDA Synthase, S100A variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCAKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 117 - DNA, 1635 bp, Artificial Sequence
  CBDA Synthase, V103A variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggctggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 118 - protein, 544 aa, Artificial Sequence
  CBDA Synthase, V103A variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKAGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 119 - DNA, 1635 bp, Artificial Sequence
  CBDA Synthase, V103F variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaagtttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 120 - protein, 544 aa, Artificial Sequence
  CBDA Synthase, V103F variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKFGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 121 - DNA, 1635 bp, Artificial Sequence
  CBDA Synthase, T109V variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtgttagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 122 - protein, 544 aa, Artificial Sequence
  CBDA Synthase, T109V variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRVRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 123 - DNA, 1635 bp, Artificial Sequence
  CBDA Synthase, Q124D variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttccgatgtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 124 - protein, 544 aa, Artificial Sequence
  CBDA Synthase, Q124D variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISDVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 125 - DNA, 1635 bp, Artificial Sequence
  CBDA Synthase, Q124E variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttccgaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 126 - protein, 544 aa, Artificial Sequence
  CBDA Synthase, Q124E variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISEVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 127 - DNA, 1635 bp, Artificial Sequence
  CBDA Synthase, Q124N variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttccaatgtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 128 - protein, 544 aa, Artificial Sequence
  CBDA Synthase, Q124N variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISNVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 129 - DNA, 1635 bp, Artificial Sequence
  CBDA Synthase, V125E variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagaacctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 130 - protein, 544 aa, Artificial Sequence
  CBDA Synthase, V125E variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQEPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 131 - DNA, 1635 bp, Artificial Sequence
  CBDA Synthase, V125Q variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaacaacctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 132 - protein, 544 aa, Artificial Sequence
  CBDA Synthase, V125Q variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQQPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 133 - DNA, 1635 bp, Artificial Sequence
  CBDA Synthase, I129V variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcgttgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 134 - protein, 544 aa, Artificial Sequence
  CBDA Synthase, I129V variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVVVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 135 - DNA, 1635 bp, Artificial Sequence
  CBDA Synthase, L132M variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacatgagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 136 - protein, 544 aa, Artificial Sequence
  CBDA Synthase, L132M variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDMRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 137 - DNA, 1635 bp, Artificial Sequence
  CBDA Synthase, S137G variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgtggtatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 138 - protein, 544 aa, Artificial Sequence
  CBDA Synthase, S137G variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRGIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 139 - DNA, 1635 bp, Artificial Sequence
  CBDA Synthase, H143D variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtcgattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 140 - protein, 544 aa, Artificial Sequence
  CBDA Synthase, H143D variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVDSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 141 - DNA, 1635 bp, Artificial Sequence
  CBDA Synthase, V149I variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttggattgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 142 - protein, 544 aa, Artificial Sequence
  CBDA Synthase, V149I variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWIEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 143 - DNA, 1635 bp, Artificial Sequence
  CBDA Synthase, W161K variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattacaaagttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 144 - protein, 544 aa, Artificial Sequence
  CBDA Synthase, W161K variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYKVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 145 - DNA, 1635 bp, Artificial Sequence
  CBDA Synthase, W161R variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattacagagttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 146 - protein, 544 aa, Artificial Sequence
  CBDA Synthase, W161R variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYRVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 147 - DNA, 1635 bp, Artificial Sequence
  CBDA Synthase, W161Y variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactatgttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 148 - protein, 544 aa, Artificial Sequence
  CBDA Synthase, W161Y variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYYVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 149 - DNA, 1635 bp, Artificial Sequence
  CBDA Synthase, K165A variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgaggctaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 150 - protein, 544 aa, Artificial Sequence
  CBDA Synthase, K165A variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEANENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 151 - DNA, 1635 bp, Artificial Sequence
  CBDA Synthase, E167P variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatccaaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 152 - protein, 544 aa, Artificial Sequence
  CBDA Synthase, E167P variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNPNLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 153 - DNA, 1635 bp, Artificial Sequence
  CBDA Synthase, N168S variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagtctttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 154 - protein, 544 aa, Artificial Sequence
  CBDA Synthase, N168S variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNESLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 155 - DNA, 1635 bp, Artificial Sequence
  CBDA Synthase, S170T variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttaactttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 156 - protein, 544 aa, Artificial Sequence
  CBDA Synthase, S170T variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLTLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 157 - DNA, 1635 bp, Artificial Sequence
  CBDA Synthase, L171I variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctattgctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 158 - protein, 544 aa, Artificial Sequence
  CBDA Synthase, L171I variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSIAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 159 - DNA, 1635 bp, Artificial Sequence
  CBDA Synthase, A172V variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggttgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 160 - protein, 544 aa, Artificial Sequence
  CBDA Synthase, A172V variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLVAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 161 - DNA, 1635 bp, Artificial Sequence
  CBDA Synthase, Y175F variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggtttttgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 162 - protein, 544 aa, Artificial Sequence
  CBDA Synthase, Y175F variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGFCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 163 - DNA, 1635 bp, Artificial Sequence
  CBDA Synthase, C180A variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgttgctgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 164 - protein, 544 aa, Artificial Sequence
  CBDA Synthase, C180A variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVAAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 165 - DNA, 1635 bp, Artificial Sequence
  CBDA Synthase, A181V variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgttggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 166 - protein, 544 aa, Artificial Sequence
  CBDA Synthase, A181V variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCVGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 167 - DNA, 1635 bp, Artificial Sequence
  CBDA Synthase, N196Q variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtcaatacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 168 - protein, 544 aa, Artificial Sequence
  CBDA Synthase, N196Q variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRQYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 169 - DNA, 1635 bp, Artificial Sequence
  CBDA Synthase, N196T variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtacttacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 170 - protein, 544 aa, Artificial Sequence
  CBDA Synthase, N196T variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRTYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 171 - DNA, 1635 bp, Artificial Sequence
  CBDA Synthase, N196V variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtgtttacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 172 - protein, 544 aa, Artificial Sequence
  CBDA Synthase, N196V variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRVYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 173 - DNA, 1635 bp, Artificial Sequence
  CBDA Synthase, H208T variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgccactttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 174 - protein, 544 aa, Artificial Sequence
  CBDA Synthase, H208T variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDATLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 175 - DNA, 1635 bp, Artificial Sequence
  CBDA Synthase, A235P variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtccagaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 176 - protein, 544 aa, Artificial Sequence
  CBDA Synthase, A235P variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGPESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 177 - DNA, 1635 bp, Artificial Sequence
  CBDA Synthase, A250T variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttactgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 178 - protein, 544 aa, Artificial Sequence
  CBDA Synthase, A250T variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVTVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 179 - DNA, 1635 bp, Artificial Sequence
  CBDA Synthase, M256V variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactgttttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 180 - protein, 544 aa, Artificial Sequence
  CBDA Synthase, M256V variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTVFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 181 - DNA, 1635 bp, Artificial Sequence
  CBDA Synthase, K260C variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgtttgtaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 182 - protein, 544 aa, Artificial Sequence
  CBDA Synthase, K260C variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVCKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 183 - DNA, 1635 bp, Artificial Sequence
  CBDA Synthase, K260W variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgtttggaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 184 - protein, 544 aa, Artificial Sequence
  CBDA Synthase, K260W variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVWKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 185 - DNA, 1635 bp, Artificial Sequence
  CBDA Synthase, L268I variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagattgttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 186 - protein, 544 aa, Artificial Sequence
  CBDA Synthase, L268I variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHEIVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 187 - DNA, 1635 bp, Artificial Sequence
  CBDA Synthase, H309V variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattgttacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 188 - protein, 544 aa, Artificial Sequence
  CBDA Synthase, H309V variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIVTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 189 - DNA, 1635 bp, Artificial Sequence
  CBDA Synthase, T310A variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacgcttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 190 - protein, 544 aa, Artificial Sequence
  CBDA Synthase, T310A variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHAYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 191 - DNA, 1635 bp, Artificial Sequence
  CBDA Synthase, T310C variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcactgttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 192 - protein, 544 aa, Artificial Sequence
  CBDA Synthase, T310C variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHCYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 193 - DNA, 1635 bp, Artificial Sequence
  CBDA Synthase, F316Y variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgtttatttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 194 - protein, 544 aa, Artificial Sequence
  CBDA Synthase, F316Y variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVYLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 195 - DNA, 1635 bp, Artificial Sequence
  CBDA Synthase, L326I variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatattatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 196 - protein, 544 aa, Artificial Sequence
  CBDA Synthase, L326I variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDIMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 197 - DNA, 1635 bp, Artificial Sequence
  CBDA Synthase, G378T variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatactgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 198 - protein, 544 aa, Artificial Sequence
  CBDA Synthase, G378T variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNTAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 199 - DNA, 1635 bp, Artificial Sequence
  CBDA Synthase, G378S variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaattctgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 200 - protein, 544 aa, Artificial Sequence
  CBDA Synthase, G378S variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNSAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 201 - DNA, 1635 bp, Artificial Sequence
  CBDA Synthase, K389E variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaaggaacctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 202 - protein, 544 aa, Artificial Sequence
  CBDA Synthase, K389E variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKEPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 203 - DNA, 1635 bp, Artificial Sequence
  CBDA Synthase, E406K variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaaaaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 204 - protein, 544 aa, Artificial Sequence
  CBDA Synthase, E406K variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEKDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 205 - DNA, 1635 bp, Artificial Sequence
  CBDA Synthase, S428L variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaattggccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 206 - protein, 544 aa, Artificial Sequence
  CBDA Synthase, S428L variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISELAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 207 - DNA, 1635 bp, Artificial Sequence
  CBDA Synthase, L439M variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcatgtacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 208 - protein, 544 aa, Artificial Sequence
  CBDA Synthase, L439M variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGIMYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 209 - DNA, 1635 bp, Artificial Sequence
  CBDA Synthase, N466D variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctatgatttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 210 - protein, 544 aa, Artificial Sequence
  CBDA Synthase, N466D variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYDFMTPYVSKNPRLAYLNYRDLDIGINDPKNPNNYTQARIWGEKYFGKNFDRLVKVKTLVDPNNFFRNEQSIPPLPRHRH

SEQ ID NO: 211 - DNA, 1635 bp, Artificial Sequence
  CBDA Synthase, K474S variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttcctctaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 212 - protein, 544 aa, Artificial Sequence
  CBDA Synthase, K474S variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSSNPRLAYLNYRDLDIGINDPKNPNNYTQARIWGEKYFGKNFDRLVKVKTLVDPNNFFRNEQSIPPLPRHRH

SEQ ID NO: 213 - DNA, 1635 bp, Artificial Sequence
  CBDA Synthase, Y499M variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaatatgactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 214 - protein, 544 aa, Artificial Sequence
  CBDA Synthase, Y499M variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNMTQARIWGEKYFGKNFDRLVKVKTLVDPNNFFRNEQSIPPLPRHRH

SEQ ID NO: 215 - DNA, 1635 bp, Artificial Sequence
  CBDA Synthase, Y499V variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaatgttactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 216 - protein, 544 aa, Artificial Sequence
  CBDA Synthase, Y499V variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNVTQARIWGEKYFGKNFDRLVKVKTLVDPNNFFRNEQSIPPLPRHRH

SEQ ID NO: 217 - DNA, 1635 bp, Artificial Sequence
  CBDA Synthase, N527E variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccagaaaacttcttcagaaacgaacaatctatcccaccattgcctagacatagacactag

SEQ ID NO: 218 - protein, 544 aa, Artificial Sequence
  CBDA Synthase, N527E variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPENFFRNEQSIPPLPRHRH

SEQ ID NO: 219 - DNA, 1635 bp, Artificial Sequence
  CBDA Synthase, P538T variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaactttgcctagacatagacactag

SEQ ID NO: 220 - protein, 544 aa, Artificial Sequence
  CBDA Synthase, P538T variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPTLPRHRH

SEQ ID NO: 221 - DNA, 1635 bp, Artificial Sequence
  CBDA Synthase, R541E variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctgaacatagacactag

SEQ ID NO: 222 - protein, 544 aa, Artificial Sequence
  CBDA Synthase, R541E variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPEHRH

SEQ ID NO: 223 - DNA, 1635 bp, Artificial Sequence
  CBDA Synthase, R541V variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctgttcatagacactag

SEQ ID NO: 224 - protein, 544 aa, Artificial Sequence
  CBDA Synthase, R541V variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPVHRH

SEQ ID NO: 225 - DNA, 1635 bp, Artificial Sequence
  CBDA Synthase, H542V variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagagttagacactag

SEQ ID NO: 226 - protein, 544 aa, Artificial Sequence
  CBDA Synthase, H542V variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRVRH

SEQ ID NO: 227 - DNA, 1635 bp, Artificial Sequence
  CBDA Synthase, R543A variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatgctcactag

SEQ ID NO: 228 - protein, 544 aa, Artificial Sequence
  CBDA Synthase, R543A variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHAH

SEQ ID NO: 229 - DNA, 1635 bp, Artificial Sequence
  CBDA Synthase, R543E variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatgaacactag

SEQ ID NO: 230 - protein, 544 aa, Artificial Sequence
  CBDA Synthase, R543E variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHEH

SEQ ID NO: 231 - DNA, 1635 bp, Artificial Sequence
  CBDA Synthase, H544E variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagagaatag

SEQ ID NO: 232 - protein, 544 aa, Artificial Sequence
  CBDA Synthase, H544E variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRE

SEQ ID NO: 233 - DNA, 1635 bp, Artificial Sequence
  CBDA Synthase, H544D variant Codon optimized
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagagattag

SEQ ID NO: 234 - protein, 544 aa, Artificial Sequence
  CBDA Synthase, H544D variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRD

SEQ ID NO: 235 - DNA, 500 bp, Artificial Sequence
  Flanking homology ui1
gcttgtactgaaattaacgagaagattgctttgtcgagacgtatcgaaaagcattggcgtttgattggttgggcaaccattaaaaagggtactacattggaacccatcgcttaaggaaccaataaaaccactgcaaagacaaaaatttcataattaatctgaaagaaagtgaagataagaaacgggctaggaggaagggaaactgacacttctggttattgcaatatgctcatatacattgatgcgtaatgacattgatgatctttattctctttttataacgttttctttctttttttttccttcttacatagtattcaactgtatatttaacatgttttacgtatttttaagaaaaaattactaaacgcgataatattaagcaaatatttatctcatagttctcgaactcatttatttcccattgatgccatgaaaacctctcaaacctttatcgtctagttacaccagtagtcaataaactgcctttctttttttac

SEQ ID NO: 236 - DNA, 500 bp, Artificial Sequence
  Flanking homology di1
acaattgcacaaagataatgaagctccaaaattattcagtatctattgagtatatataaccttgaaaaggttttattttatataagttcgccatcttagtatagtggttagtacacatcgttgtggccgatgaaaccctggttcgattctaggagatggcatatttattttttatattcttaatatacaaagaatgtcgtgtgaagctgtaggcacaggtaattttgtaaccatagtcagatgtggtgatcatgagagcgaattataattttataccagctggcaagaattgagtaatatttagaccagcatataaaagtagaataaaaagttatatgtacaaattttttttgacgccaggcatgaacaaaaactactatggctttggaattttcaagctcttcgaaatcattccacacccatggataaaaaatactagaataattggatgaaattccaatatttggtcttctctaaaaatgccgaatgggatgttatca

SEQ ID NO: 237 - DNA, 500 bp, Artificial Sequence
  Flanking homology ui2
agttttgccgctttgcttgatcactgttagtatttcggcaaattatatggtattggtcgccttgccaggttctttaggaagttcatcataaactaacgctttcaagaatttacggaaatgatagggtttatagtttttataacagtagtggacctagaaaacaccgatagctggcggcggttatatctcattactactatgaaaactgtggctcctgagtagctactgaaggatgtgcccatcttaatccagacctagtcaatacaatcaatacaactgtctagctgaaaactgacaaaaaagtttgtcgatgtctctagtatattcactataacactaaattttattgtaaattattacacaagttttcaagaagaaaaacaatattaaacacaataactagattatgcgaggcacggcaaaaggagtgaagagggcaaaatacggagaagacaatatagaataaatttctttttttgattagagaagattgtttgcca

SEQ ID NO: 238 - DNA, 500 bp, Artificial Sequence
  Flanking homology di2
atagtcttaccatgatgatcagtcggattctgacgacgttgggtattttaaaacacgcgtaattgaaagggtgatgttgagaatggaccacttcaagatatgctcgaaaatgtagctatatttcacggatgaataactcgtaagaatgtgcagtagctgatggacctaggaacgatcaagtcaacgttgtattttggttcggcaaacaattgatatgatgttgacaagaaaaccatctgcgctctaatctctaagtacacgtgcatttggacctatcatcaaaagagaataagaggatactttcaagagaagttcaaaaaagaatcattattatgatccaatgacagtgacaataagatcaacataaaaaagaaaagtcagaagtataaatctgggtctttttctctaaaataattatagtctgttaatttataaaactgcctaaaaaatatacttaaaatatgtctacagattatgcagctggaaaaaatcaagcaaaa

SEQ ID NO: 239 - DNA, 500 bp, Artificial Sequence
  Flanking homology ui3
ccagttatcctaggcaattactttatttgagtcttatatgacgtcactagaagctcagtaagagcaaccgagacctgaacatccttttttttttttgcttctttatttggcagcatttttcaaaaataataaaatggaagccgcgagtacgaacaatgatgtgttctgggaatacctcgtcaaaacaagacaatggtaaggattttctttcatcaggcagaaagatctggatctgaatggcatcattttgtgatgtgtaaaagcgggaccttgttatttcgactttttgcatcatgttgatgcaatttgctacttttccgacggtgcgctccaacggatgggtatttccttaataacaaggcatttctctggaagttggcttactgtttgaaatcacagccggtcacaaaataaagtaaaaaaactatctctctccacaagaagtaattacaggttgtatactacgtgtgatcgtatttctttatgaacactaaggagtt

SEQ ID NO: 240 - DNA, 500 bp, Artificial Sequence
  Flanking homology di3
cgtgtctgaaaaatcttgaattttcagaaaagaataagccccaaatgtcagtgatggtagtagcagtactcccctacgattttagatactttagagagcccaccttcagaatcggaaggaggataattttgtaaagcccttctgttttttctcttgcataacttatatttccacatcaaaaagtagtgtgctaagaaaaaggagacgagaaaaaggattacggcactctctgcatctagacatataccaaaagttgggtttgctcacgaaaataccataattgtggtgtcaaaaaaatcctgcctcataataccactgcagcaattgtggatgactaaaaaataacttgcattccacgatgttattttactttataaagcacctgcaatttttttttttgtattaactcatcgagtatgtctgatgtgtaaactgaaccaggcttaatatcgtttctaattcttgttgtgagaaaactttcctgcctaatgtatttcgtc

SEQ ID NO: 241 - DNA, 500 bp, Artificial Sequence
  Flanking homology ui7
taaaattttactcatagtagataatggcataaatcagtggtaaaaaaagaatacgcatgacaaattttgaaaaccgtacgtgacataaaatacctataataagatgaagacatcaattctcaagttccacttttcgccggttgagtgtatcggtcatagtacaaaggcagaaatgaataatagtaatattaatcgcagtttcctgttgtttagagaactgaaacgctttgtgggcatcaggtttagattaactgctacccttcttctgtatttgtctggccatgcttctcaaataaaccgctgcggataacatttcaagtggtttctcaagggagaatcatagtttagcttaacatacagcaaatcgtcactatcttgactgatgcccggtgtatagagaatgggtagttaatatcatctagatggggtttctttgaaaacaccagtttctttgaggacaccagtttcagtgcttctctctaccccatcaactattgcac

SEQ ID NO: 242 - DNA, 500 bp, Artificial Sequence
  Flanking homology di7
cgtcttgcttttttcggtagtttttcgtttcgataaaggcaacaatgctgtatattgtatgcaggaagttcttaaggaaaatacaggaatctttagaaaaagaataaatagctttccattgtatcatgaacaagtcactcttcatattatatgtcgtcgcttcttatccctttaagttatgaattgttgagcttaggattttaccacaactgaataacattttctttattctaataatcgattttttttaataagattagacttgagtgccatcagcaaagaaaaatacttttaatgtcctttttttaactctacacagaatttagttggctgtttcattgatttacaaaaatataaatatataccgttaaaattatagcgataaactgagtatgtggtctctcttttcccgcagaatatgaaagcttttcttttataaatcttataatattggtctctttttggtacgtttggcaaattggcattcatttatcatgaaa

SEQ ID NO: 243 - DNA, 503 bp, Artificial Sequence
  Flanking homology ui10
aggaccacttcatcaagtttcgaaagtgaaattaaatccatttcagaaaatttcaagaactctattccagaatcttccatactcttcaggatatcatataataacaactctaataatacctctagtagcgagatcttcacacttttggtagaaaaagtttggaattttgacgacttgataatggcgatcaattctaaaatttcgaatacacataataacaacatttcaccaatcaccaagatcaaatatcaggacgaagatggggattttgttgtgttaggtagcgatgaagattggaatgttgctaaagaaatgttggcggaaaacaatgagaaattcttgaacattcgtctgtattgataaataaaactagtatacagcaaatactaaataattcaagaaaaaaacattagatagagaggggcagatgttcaagctatacccattatattgatccacacttagtattaagatacgtctgtgaaggatgaaaaaaaatgtat

SEQ ID NO: 244 - DNA, 485 bp, Artificial Sequence
  Flanking homology di10
ttgtgcgtttttataatttttttttttttgtaattctatgcaaatgtaatataagtatatttaaagaaataatgagtcctgtgaaaacaaaaagaaaaaaagatcattaatgtatgttaacgtatttgctttgcaaattttaatttatttgttgttaaatgcattttttttttgtcgtttcagcgagttttcttgaggttgctactatcattaaaatcacaatccacagaggaagttgatctctttttcagttgggtgggggcagagcatgggtgagcagtggccatgggtctaacaggaaataatctttttgaacgcacagataaattttgtaataattttctatttgacattagagatggggtggtgggagttagtgggcttggccaaaagatgcttgaattttgtgggatgctcagtgaccttttaaaagaattttgggtagaagagaacgaacctgaatgtgaatggtgtgatgcagagtc

SEQ ID NO: 245 - DNA, 490 bp, Artificial Sequence
  Flanking homology ui21
ccatctatccttcgcctctccttcgctctgtaattttttttactcgcgcgcttccgacttttgaaagaaggagcaataaagttaaataaatgtaattaaattatgcttttttaggcaagttcgggactttgttgccacgtattgctcttctatgcaagcacttcactccttttctttcatctctgttttcttccactggctggaagcttgagggttgcctcttgattctttatcgcctgcaaccattgccttgttccgtcctctcaaggcgttccttccgtgctttttaaatactagaatcattcgagacgtatttatgagcatgttacttcttgatgtttatctaagagggttgtttaggttatccgcattatttttaaagttttaaggttacatcatttattcagacgcgttcggaggagagtgcattcaccaagatgtaaatttcttcagttttccggattaggattggaaaaatgaagaaaaatag

SEQ ID NO: 246 - DNA, 500 bp, Artificial Sequence
  Flanking homology di21
ctaaagtaattgtagcagttgttattaaggagttctttaaatcatattgcttgcttgtatcagaccattggaaacttcaatgtttaaactctagaaaggttgatctgctcaaatattttcatatttacggcatgtcctaacttgaacatttgtagaagagagacatatttcttagtgtaggcaagatatttgaatgacattgtctgccgaaatatactcgacttgcagtggaactgcaagtcgaaaaggatatcgctttagccaaacaaaaatttgttgtgctattcagtgagcatgcattggctatagaggccgcacctaaattgtatcttttgatttatgtaactgccacactttctctagcacagtcatgatacggctttttttcatttagccaccaaatactgtaaatatcgttttagaacgttatgaaaaaatgctcatccacttaaaaacctctccgtattctgaaagttggtataatcttgcactttaagtgt

SEQ ID NO: 247 - DNA, 503 bp, Artificial Sequence
  Flanking homology ui33
tctgttaaccattctggttcacttgccgtcgtatgttgcggaccacctattttcgtcgacaccgctagaaatcaaactgccaaagctgttatcagaaacccatcaagaatgattgaatacttggaggaataccaagcctggtgaacaatttttcatatttaagtaaacactcaatgtataatatcctctaactgttgtaatttcattaacgtaaatggtttgcgccttttttaggggacccttgttgattcattctaactactgaggcataagttgtttcaaataacactttttcagaaaaataatcgtattaaaaagcagaaaaatcatacgtaagatgacagaagcttcatatttagtaactctgaattgtataacacaccaattgccgatagaatatgaaccaatcgatcttcagcgttcatgtacttaatttaactacctgtattttcttataaagataaaattggtgtataatgtaagggccaagagaaaaaggaatc

SEQ ID NO: 248 - DNA, 494 bp, Artificial Sequence
  Flanking homology di33
atttcttcaaaaaaataactgaataaacacctatataatgttcagaggttatactttagtgttttagaatgcagtaccaaaagtaatatattgaattaataactatatgatgtgtagctaagaattaaatagtaaacgtcttctgaaaccttttaagaggtaattattggtattccaaagtcatatgtggaggtaagggagacacaaaattatctggaatgacagcgtgctgacacatataaagttccgtaacttcaaatgccttcattattcaacataggaaaagtgaaatgtgtgcctctaaaatatacggaacatcgtcgaactaaaaaaatccattaagcaaagttagaaacagcatgcactacaagacatttggttcatcatgaagaatgctcaattgaaccatcaatcactttctcttgttcgatgttagcattatcctcactatcagttgaatcctcaatgctttcggtttcagtcctcgcatcttc

SEQ ID NO: 249 - DNA, 502 bp, Artificial Sequence
  Flanking homology ui34
tgagcaaccaatcacttctgaaaccgctatgaagaaggttgaagatggtaacattttggttttccaagtttccatgaaagctaacaaataccaaatcaagaaggccgtcaaggaattatacgaagttgacgtattgaaggttaacactttggttagaccaaacggtaccaagaaggcttacgttagattgactgctgactacgatgctttggacattgctaacagaatcggttacatttaatctaattggtttaattaataaatttaatattatttttaaatttttctttaaatatacaataaatctttcataacatgttaaattcatgattaagcgtaaataaagtgtagtggcagagtgcacggggtttcctgtgccttacaaagtaggtaccaatttgcgtattgcagcgagggttccggttactatttataattacgtgttagtgtactgtgattttattgaggctataacaagaaaaggatctgtgaaggttttgag

SEQ ID NO: 250 - DNA, 492 bp, Artificial Sequence
  Flanking homology di34
cccttttcttttcgcaagatgagagtaaagagttgtacatcaggtaagaatgttattatttaaattcgaagtgataaattcttttcatgatgaatcactcgcttatatggggtagaatatatatatatgtgtgtgtgtgtgtgtgtttgtgtatgtagggatggtgcgcgtttgttgtgtgacatttgctactcattcttttccttttcctacgactggcttaacgggaatattatcaatttgctgcattcttatgcttcggtccgatgctcattaagatgatgcagatctcgatgcaacgaattccaagcccttatcgatatttttctttaactgggagacgcaaattggcaacatttggttgcgttccatgtcgttcatcctattaacgatgtcataatccacataggaaacaccctttgtagtaatagttaatggtatggcaaagtagtctgcaccgtccaccagaggcaataattgatctgccccagg

SEQ ID NO: 251 - DNA, 500 bp, Artificial Sequence
  Flanking homology ui1001
atgagttaacgtagattactttccgttagtgtaacggacaagatgacacagtattgaaacgctcctctatctttgtgggtgttgagggaggagagagttattagtctagacgctatatatcacagagtcgagtgcccaataatatagcaggtagacgccaacttaactactggatgtgagttagagaggaatatactgttttattaactcgtaccgtagtggtttctggcgagaattcgccggcttaaaatctattgactaactagaattagcttaaagtggaccttattgaatctcaccgggttatcgcgacatttatattatcgaagggtccagcttggggtttgtttggaaggttgacttgttgttgtagttgtatcactaataattacgattctcaacgaccggcccaaagattgcctgggttaaattcagcgtctgatgtatacttagctcttcgcaagtagtgttctaattaaagatcacttcaacttatcttc

SEQ ID NO: 252 - DNA, 500 bp, Artificial Sequence
  Flanking homology di1001
aaggtaacttaggctgacgacgcaataatgcacgctcgcgtgtgatgagattacatcagtaagaattcatatctcgatatgggataattacgggctcacactctaggaataccaagaacagtaatgtttccttattaatatgtagataaggatcttcttaaagtttaattgatggcgaattccaaatagtgacttaactttcgcgcagagtatcgcaggacaaggttagcttttcgtaagcctgatgttatgccataactagccaccttgtaatccccgcgctcagtaaatctatctacttatttgcttcacttcttcacggagagtactgattttcttctctcaatactactgactaccttagggcgacatactttagttctgcataagcgtcaacctcttgcctaagggtatggatccttgttaagccttattccatatagttgagctgaagaacagatccctcaactcgagtgcgactagtagctagttacgaacac

SEQ ID NO: 253 - DNA, 508 bp, Artificial Sequence
  Flanking homology uPEP4
tgttaatccgttttcaatatcttgagctcctcaattgtatttgctgaggtctgattatttctataaccaaaagcggttattgaatctatggagaggctgtaacccgtcttatgccttccgggtactatatttcatttgcgggtgtcgatggattaaggggcggaggcggccctttttaggatttatataaaaagccatacttccgtacttcgtaacctcttatcaactggttaagggaacagagtaaagaagtttgggtaattcgctgctatttattcattccaccttcttcttttttgagcgaagcctttataatcaaattttagtggtcttttctatttttatttgagaagcctaccacgtaagggaagaataacaaaaagtatatctcaccctactgtattcataaaaagttttttctattagaattctataagaaaagaaaaaaaaaaagcctagtgacctagtatttaatccaaataaaattcaaacaaaaaccaaaactaac

SEQ ID NO: 254 - DNA, 509 bp, Artificial Sequence
  Flanking homology dPEP4
gctaaacttttcttacttctccgccctatccttttctgccatctagagagcttttataagtagataacaataaaaaaaactatagtatatttaaaaaaaaaaaacaagacaaaccatcttgtcctcagttttagaatccattgttctatgctgctgcccataatgtcattatatgcgggtagcccgatgatgcggctcgagaatttccttgtttatccttttccaatagcggaacaattgataataaagcaatgtaagcagaagcgaaaaataaaaagaaataggctgcagagattcacaggctgcgctctagaaacatttgaaatcaaggcaaacatagaacacttgataaaattcttaccataataccaccattgatgattcaaaaaatgagcccaagcttaaggaggccatcaacgaggtctagttctggttcaagtaatatcccacaatcgccctctgtacgatcaacttcatcgttttctaatctgacaagaaactccatacgg

SEQ ID NO: 255 - DNA, 503 bp, Artificial Sequence
  Flanking homology uROT2
gctgcattcttcagtggtatgttatttatgtaacgggtatgcgaaccacaacgccagattcttgaaggggaaacctaactacacagtcttagcaacaaccgccggcgctctgggtcttttgacgctggacggtataatttcaaagaaatactactccagatacgacaagaaataataacatactatttaataacatccttttcacacactcacacactcacatactttatatacatatatttttataactattactgctgatttatttgtaaggaaacgtgctttcctcttcatcggtcaagtgataagtttctataatataatagcttttctgtctactatcattcttttttcatttcaagtacccttaatttgttttacccggaccacgaaattttctcactacggcacttgagagctataactcaatgaacatgttgcttggagtgatttgattgctctgcgtatcttaaaatagcggtctcgaatcaaccgtatgcaac

SEQ ID NO: 256 - DNA, 499 bp, Artificial Sequence
  Flanking homology dROT2
gggaaaaaaacgaaggggtatctttacatctttttagctctttcttgcaaattaaacgtaaaaatatccgtaaatataacatataaccattatctatagaaaaaaagaaccgaaaattgtgtcaggccctacttcccgtgagctaacttcattcttgtcgaaaacttgactagggtcgtccagtcgcaaaacgtatcacatttcggacatttcccacctcgaggtatcaagtttcttctccctactatcaactgttcatcatctagaaagtacctgtgaagacatttcaagtggttaacagacccgcagtctttattattgcaaagcgctacaaacggcttcagattttgctcttcagacgtgtagtcaatttctttctcacaaatttcacatcgcactacccctgtagttagtttcttttcgaaagtttcgaatatgtttctttcattttcaatgactttagtgtatacagcttctaccacttttaaattctcatcac

SEQ ID NO: 257 - DNA, 36 bp, Artificial Sequence
  Linker D0
atcgacgggccggccagtgtctctcgtttaaacttg

SEQ ID NO: 258 - DNA, 36 bp, Artificial Sequence
  Linker D2
atgagtatgctatactcccactaatggcatcacgct

SEQ ID NO: 259 - DNA, 36 bp, Artificial Sequence
  Linker D3
taggcaagaatagcggagcactaggtttcgacttaa

SEQ ID NO: 260 - DNA, 36 bp, Artificial Sequence
  Linker D4
acgatccacggcttctaaagactgacaattgctttc

SEQ ID NO: 261 - DNA, 36 bp, Artificial Sequence
  Linker D9
caaagctaggccggcccttagtactagtttaaaccg

SEQ ID NO: 262 - DNA, 36 bp, Artificial Sequence
  Linker D20
tcggagcaaatgaaacgattccgataagtgttgcaa

SEQ ID NO: 263 - DNA, 36 bp, Artificial Sequence
  Linker D21
ttgtgggtgaaagaaggagaggtacgtttctatcgt

SEQ ID NO: 264 - DNA, 36 bp, Artificial Sequence
  Linker D22
agacagacccgccttaatctacaagattcgtgacat

SEQ ID NO: 265 - DNA, 36 bp, Artificial Sequence
  Linker D23
cattatatttcctacggagtcggaagcagggacgta

SEQ ID NO: 266 - DNA, 36 bp, Artificial Sequence
  Linker D30
ggaccaccagtaacactccaattctgggtgatttac

SEQ ID NO: 267 - DNA, 36 bp, Artificial Sequence
  Linker DH7
ctcttattaccctatcctatggtactttctcggcag

SEQ ID NO: 268 - DNA, 36 bp, Artificial Sequence
  Linker G1
acctctatactttaacgtcaaggagaaaaaactata

SEQ ID NO: 269 - DNA, 36 bp, Artificial Sequence
  Linker G7
catgataaaaaaaaacagttgaatattccctcaaaa

SEQ ID NO: 270 - DNA, 36 bp, Artificial Sequence
  Linker G10
aaaaaaaaagtaagaatttttgaaaattcaatataa

SEQ ID NO: 271 - DNA, 36 bp, Artificial Sequence
  Linker RG1
tatagttttttctccttgacgttaaagtatagaggt

SEQ ID NO: 272 - DNA, 36 bp, Artificial Sequence
  Linker LTTDH1
ataaagcaatcttgatgaggataatgattttttttt

SEQ ID NO: 273 - DNA, 635 bp, Artificial Sequence
  Promoter pGAL1
tttggatggacgcaaagaagtttaataatcatattacatggcaataccaccatatacatatccatatctaatcttacttatatgttgtggaaatgtaaagagccccattatcttagcctaaaaaaaccttctctttggaactttcagtaatacgcttaactgctcattgctatattgaagtacggattagaagccgccgagcgggcgacagccctccgacggaagactctcctccgtgcgtcctggtcttcaccggtcgcgttcctgaaacgcagatgtgcctcgcgccgcactgctccgaacaataaagattctacaatactagcttttatggttatgaagaggaaaaattggcagtaacctggccccacaaaccttcaaatcaacgaatcaaattaacaaccataggataataatgcgattagttttttagccttatttctggggtaattaatcagcgaagcgatgatttttgatctattaacagatatataaatgcaaaagctgcataaccactttaactaatactttcaacattttcggtttgtattacttcttattcaaatgtcataaaagtatcaacaaaaaattgttaatatacctctatactttaacgtcaaggagaaaaaactata

SEQ ID NO: 274 - DNA, 668 bp, Artificial Sequence
  Promoter pGAL1-10
tatagttttttctccttgacgttaaagtatagaggtatattaacaattttttgttgatacttttatgacatttgaataagaagtaatacaaaccgaaaatgttgaaagtattagttaaagtggttatgcagcttttgcatttatatatctgttaatagatcaaaaatcatcgcttcgctgattaattaccccagaaataaggctaaaaaactaatcgcattattatcctatggttgttaatttgattcgttgatttgaaggtttgtggggccaggttactgccaatttttcctcttcataaccataaaagctagtattgtagaatctttattgttcggagcagtgcggcgcgaggcacatctgcgtttcaggaacgcgaccggtgaagaccaggacgcacggaggagagtcttccgtcggagggctgtcgcccgctcggcggcttctaatccgtacttcaatatagcaatgagcagttaagcgtattactgaaagttccaaagagaaggtttttttaggctaagataatggggctctttacatttccacaacatataagtaagattagatatggatatgtatatggtggtattgccatgtaatatgattattaaacttctttgcgtccatccaaaaaaaaagtaagaatttttgaaaattcaatataa

SEQ ID NO: 275 - DNA, 465 bp, Artificial Sequence
  Promoter pGAL7
ggacggtagcaacaagaatatagcacgagccgcgaagttcatttcgttacttttgatatcgctcacaactattgcgaagcgcttcagtgaaaaaatcataaggaaaagttgtaaatattattggtagtattcgtttggtaaagtagagggggtaatttttcccctttattttgttcatacattcttaaattgctttgcctctccttttggaaagctatacttcggagcactgttgagcgaaggctcattagatatattttctgtcattttccttaacccaaaaataagggaaagggtccaaaaagcgctcggacaactgttgaccgtgatccgaaggactggctatacagtgttcacaaaatagccaagctgaaaataatgtgtagctatgttcagttagtttggctagcaaagatataaaagcaggtcggaaatatttatgggcattattatgcagagcatcaa

SEQ ID NO: 276 - DNA, 600 bp, Artificial Sequence
  Promoter pTDH3
ttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaa

SEQ ID NO: 277 - DNA, 648 bp, Artificial Sequence
  Promoter pTEF1
gacagcctagacatcaatagtcatacaacagaaagcgaccacccaactttggctgataatagcgtataaacaatgcatactttgtacgttcaaaatacaatgcagtagatatatttatgcatattacatataatacatatcacataggaagcaacaggcgcgttggacttttaattttcgaggaccgcgaatccttacatcacacccaatcccccacaagtgatcccccacacaccatagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagagaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaaa

SEQ ID NO: 278 - DNA, 500 bp, Artificial Sequence
  SRS SRS_A
gagatccccaaacagtttaatctctgattaactcttgcgtcgtatagtcgggcttaactctatactcaaaatcactaacaagacgtagacgcaagacgataagaccgggcaggatactatcactcaatacagttcagatatctccatctaactgtactctactcaaaaacgtcttactaaagaagaacgtctccccaacacatgtaggaaggaagtgattacttatcttttggctaaatctacataattagtcagcgaacattctagacagagagtgaaatctgacacgtgagattagtgcttatactctgattaggctcagtgaaactagctgtgcatgtaccgtgattattaggttgacataggaatttagtgcctaatatcggctcgattataaatatcagtaattcgatatcgtcatgtctttatgcttacaggtatagtaatttggccttagtggaacgatcaatcggcttctgtaatattattcaaccttccct

SEQ ID NO: 279 - DNA, 500 bp, Artificial Sequence
  SRS SRS_B
atcaatttgtgattactttgctaggtaacgccactactggtgttataattgctgttacttaagcgccttgtaatcgatataagtgaaaatacaaaacgcagcctactgttcaatcggaactttagtatattcgctgaggactagtacgtggcagaatccagttataatgttttgaatcgcttttaaggtactgaagtaatccacaggacgccaagctcttatagcacagtgggatatatttgcacgtgattattgcaaaagagctaagggtcgtacttcacgtcttttaactgagtacaacccaaatttggttcgcttcgcaagttgatagcgtagcgacacgtacagttggtttgaaacagtagtacttccttttaattcggaggcttattgtacggaaagtgttctgttaattaaggtagaccagcagaacaccgcgcaccagggattgcatatctttagggtatttcgagattgcatcccattgaaatcgtaccttt

SEQ ID NO: 280 - DNA, 500 bp, Artificial Sequence
  SRS SRS_C
gaagactaacgaacgaggtggtatatagttaccctatgtaaaatcgttaattgtcattagacaatgtttcaggagtagaattcagctagctgttagcccactggcacacgctaggacgctatcaggacggtctttgaacctataactcagtatatggttttagacctataatctgcttctaaggcacgcgggggagtaacttagatactagtgcttccaggaaaatctggcgcgataatagcccgatcttctaatagactatccctaccaaaagttataaatcattgttctcttgacgttaacatcacttgctgaaaattagaatgtgaagaaaaccataaacaaattagcctggcagacagtgaatatactctacgttgaacatatacaaaaatagaagcgccggaaagaagatccttcccagtagagtccgttaaactaatttcctaattgctaaatactgtatctacctgataatggggtcggttacttcagtttat

SEQ ID NO: 281 - DNA, 497 bp, Artificial Sequence
  SRS SRS_D
ctcgtaacttgatttaataacggaggctattgaacttaaaatcgcatctggctgttaaattcaataaacttgctttcaggttaacttcctttgattaagtcgtgaattaagatcttattacaactctggtacgtcctaagttagattaaagtactgttggaggaacggaataatatttcttgtgttacgcagctagtgaaccagtgtcacaggaggtgtaacaaccggttgaaattctaacttttgaagctttacctaagggtactgtataaggatcacattgttagtacaacgctagttcgtaggcgttcaaacttaattgtttagtagtccgcacttgactaactgacgctccttggtctgctcttcgtaattaggctttcgaaaggtacgatggaatactaagtataataacagttgtctgacaactacggtacgtatttgatgttgaggcagtgagctaactccacttagtgtgtaaccttacgtatcatata

SEQ ID NO: 282 - DNA, 500 bp, Artificial Sequence; identical to SEQ ID NO: 251
  SRS SRS_G

SEQ ID NO: 283 - DNA, 500 bp, Artificial Sequence; identical to SEQ ID NO: 252
  SRS SRS_H

SEQ ID NO: 284 - DNA, 500 bp, Artificial Sequence
  SRS SRS_J
ggtcattgaggcggtaagaatctgatttatctagatctatagcaacgtcaaataattcaaatcccgtacttttcaagattctgagggttaaggtcttgattgtgattctaaatacttgtaggtaccgagtaatagacgcgcactcagatttggtctaatacgattatttacccatagagagagtaatcgtctatggcccgtagttagcaaggttcaacgtgtattatgtactgagtacgcagatctgattaccctataatttccaagatattagtgattctaacggatatagtcaatacctcccaattccccacgcttcgattgtagtatttgattcggctgacaaacgccgacaagattcgctgtaactctttggctaatagaaaagtaaatcaacacgcgttcttaaattcttgacatgtaagtacttggaacaatcttacctgttatccattatctgtttatcgatcttacctaaccatccagtttgcctgagtggg

SEQ ID NO: 285 - DNA, 250 bp, Artificial Sequence
  Terminator tTDH1
ataaagcaatcttgatgaggataatgatttttttttgaatatacataaatactaccgtttttctgctagattttgtgaagacgtaaataagtacatattactttttaagccaagacaagattaagcattaactttacccttttctcttctaagtttcaatactagttatcactgtttaaaagttatggcgagaacgtcggcggttaaaatatattaccctgaacgtggtgaattgaagttctaggatggt

SEQ ID NO: 286 - DNA, 301 bp, Artificial Sequence
  Terminator tENO1
agcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcct

SEQ ID NO: 287 - DNA, 296 bp, Artificial Sequence
  Terminator tSSA1
gccaattggtgcggcaattgataataacgaaaatgtcttttaatgatctgggtataatgaggaattttccgaacgtttttactttatatatatatatacatgtaacatatattctatacgctatagagaaaggaaatttttcaattaaaaaaaaaatagagaaagagtttcacttcttgattatcgctaacactaatggttgaagtactgctactttaattttatagataggcaaaaaaaaattattcggggcgagctgggaattgaacccagggcctctcgcatgctttgtcttc

SEQ ID NO: 288 - DNA, 250 bp, Artificial Sequence
  Terminator tADH1
gcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactcc

SEQ ID NO: 289 - DNA, 249 bp, Artificial Sequence
  Terminator tCYC1
atcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgc

SEQ ID NO: 290 - DNA, 509 bp, Artificial Sequence
  Terminator tHUG1
agtatgcttctctttttttttgtaggccagtgataggaaagaacaatagaatataaatacgtcagaatataatagatatgtttttatatttagacctcgtacataggaataattgacgttttttttggccaacatttgaaatttttttttgttacctcgcgctgagcccaaacgggctccactacccgccgcggtcgccattttgggaagtcatccgtcccaaaaaggaaatagccataacatgtcgttactgttttggaacatcgcccgtttcgcccgattccgcctcagcgggtataaaaagagatctttttttttcctggctgtcccttcccatttttaaatgtcttatctgctcctttgtgatcttacggtctcactaacctctcttcaactgctcaataatttcccgctatgcaaaattcccaagactacttttacgctcaaaatcgctcccaacaacaacaagccccttccacattgcgtaccgtgaccatggcggaatttag

SEQ ID NO: 291 - DNA, 505 bp, Artificial Sequence
  Terminator tSPG5
aaagacgttgtttcatcgcgctattaccaagaaggttactttacttgttcttgcacatggacgcacgttgtgtgttcatatatatatatatatatatatatatatatttgtgcttgttttcattgtctctatagttaatacattctatttttatcgttatatttgcattctcttcgcataaaaacttcatgaaaattcggcagaaaataagccatatatgtactttatccataggcaaagaaaagcacttaacgagaatatacaacaattgcactagtactgcatgtatatactcttatgattatagcggcaagaaaacaaatataaacacactaacagatgaattcgaatgaagatatacatgaagaacgcattgaagttccacgaactccccatcaaacccagccagagaaagactctgatcgcatcgctctcagggatgaaatatcagtaccagaaggcgatgaaaaagcatattcggatgagaaagtagaaatggcaacca

SEQ ID NO: 292 - DNA, 522 bp, Artificial Sequence
  Promoter pGAL10
atctgttaatagatcaaaaatcatcgcttcgctgattaattaccccagaaataaggctaaaaaactaatcgcattattatcctatggttgttaatttgattcgttgatttgaaggtttgtggggccaggttactgccaatttttcctcttcataaccataaaagctagtattgtagaatctttattgttcggagcagtgcggcgcgaggcacatctgcgtttcaggaacgcgaccggtgaagaccaggacgcacggaggagagtcttccgtcggagggctgtcgcccgctcggcggcttctaatccgtacttcaatatagcaatgagcagttaagcgtattactgaaagttccaaagagaaggtttttttaggctaagataatggggctctttacatttccacaacatataagtaagattagatatggatatgtatatggtggtattgccatgtaatatgattattaaacttctttgcgtccatccaaaaaaaaagtaagaatttttgaaaattcaatataa

SEQ ID NO: 293 - DNA, 921 bp, Artificial Sequence
  aromatic prenyltransferase (NphB-ScCO) nucleotide sequence
atgtctgaggcggcagacgtagagagagtatacgctgctatggaggaagcggctggattattgggggtggcttgtgccagagacaagatatatccgttactgtctactttccaggacactcttgtagaaggagggagtgtggtggtgtttagtatggcatcaggccgtcattcaacagagctagatttcagtatatctgtgccaacaagtcacggtgatccatacgcaaccgtagtcgagaagggtcttttcccggcaacagggcatcctgtagatgatttgcttgccgacacacagaagcacctgcccgtctccatgttcgcaatcgatggtgaggtgaccggaggatttaaaaagacttacgctttcttcccgactgacaatatgccaggagttgccgagttgagtgcaataccatccatgccgccagcagtcgcggagaacgccgaattgttcgcccgttacggcttggacaaagtccaaatgactagtatggactataaaaagaggcaggtgaatctatatttcagcgaactttctgcccaaaccttggaggcggagagcgttttagcccttgttagggagttagggctacacgtcccgaatgagttgggtttgaaattttgtaagcgtagcttttcagtatatccgacgctgaactgggaaactggaaagattgacaggctatgctttgcagtgatttctaatgaccctacgcttgtaccttcctcagacgagggcgacatcgagaaattccacaactatgccacaaaagctccgtatgcctacgtcggcgaaaaacgtactctagtatacggtttgactctgagtcccaaggaagagtattacaagctaggagcgtactatcatatcactgatgtgcaacgtggcttgctgaaagccttcgactccttagaggac

SEQ ID NO: 294 - protein, 307 aa, Unknown [sequence omitted]

SEQ ID NO: 295 - DNA, 3349 bp, Artificial Sequence
  IRE1 fragment
atgcggtctacttcgaagaaacatgttagtattgacactgctcgtttgtgtgttttcatccatcatttcatgctcaatcccattgtcgtctcgcacctcaaggcggcagatagtggaagatgaagttgcctccactaaaaagctcaatttcaactatggtgtggataaaaatataaactcgcccattcctgctccaagaaccactgaaggtttaccaaatatgaaactcagctcatatccaactcctaacttattgaatactgctgataatcgacgtgctaacaaaaaaggacgtagggctgccaattctataagtgtaccctatttggagaatcgttccttgaacgaactgagtttatcagatatactaatcgcagccgacgttgagggtggacttcatgctgtagatagaagaaatggtcatatcatatggtcaatcgaaccagaaaattttcaacctctgatagaaatacaagaaccttcgaggttagaaacatatgaaacgttgattatagaacctttcggtgatgggaacatttactactttaacgcccatcaagggttacaaaaactgcctttatccatacgacaacttgtatcaacttccccgctgcacttgaaaacaaatattgtggttaatgactctggaaaaattgttgaagatgaaaaggtctacactggatcgatgagaactataatgtatactataaacatgttgaatggtgaaattatatcagcgttcggacctggttcaaaaaacgggtatttcgggagccagagtgtggattgctcacctgaggagaagataaaacttcaggaatgtgaaaatatgattgtaataggcaaaactatttttgagctgggaattcactcttatgatggagcaagctacaatgtcacttactctacatggcagcaaaatgttttagatgttcccctagcgcttcagaatacattttcaaaggacggcatgtgcatagcgcctttccgtgataaatcattgctagcaagcgatttagattttagaattgctagatgggtttctccgacattccccggaattattgttgggcttttcgatgtgtttaatgatctccgcaccaatgaaaatatactggtaccgcatccctttaatcctggtgatcatgaaagtatatcgagtaacaaagtttacttggatcagacttcgaacctctcctggtttgcattatctagtcagaattttccatctttagtcgaatcagctcccatatcaagatacgcttccagtgaccgttggagggtgtcttcaatttttgaagatgagactttattcaagaacgcaatcatgggtgttcatcagatatataataatgaatatgatcacctttatgaaaactatgaaaaaacgaatagtttggacactacgcacaaatatccacctctgatgattgattcgtccgttgatacaaccgatttacatcagaataacgagatgaattcactaaaggaatacatgtcaccagaagaccttgaggcatatagaaaaaagatacacgagcaaatatcgagagaattagatgaaaagaaccaaaattctttgctactgaagtttggaagtctagtatatcgaattatagagactggagtatttctgttgttatttctcattttttgtgcaatactacaaagattcaaaattttgccgccactatatgtattattatccaaaattggatttatgcctgaaaaggaaatccccatagttgagtcgaaatcgctaaattgtccctcttcatcggaaaatgtaaccaagccattcgatatgaaatcagggaagcaagttgtttttgaaggtgctgtgaacgatggaagtctaaaatctgaaaaagataacgatgatgctgatgaagatgatgaaaaatcactagatttaaccacagaaaagaagaagaggaaaagaggttcgagaggaggcaaaaagggccgaaaatcacgcattgcaaatataccaaactttgagcaatctttaaaaaatttggtagtatccgaaaaaattttaggttacggttcatcaggaacagtagtttttcagggaagttttcaaggaagacctgttgcggtaaagagaatgttaattgatttttgtgacatagctttaatggaaataaaacttttgactgaaagcgatgatcaccctaacgtcatacgatactactgttcagaaacaacagacagatttttgtatattgctttagagctctgcaatttgaaccttcaagatttggtggagtctaagaatgtatcagatgaaaacctgaaattacagaaagagtataatccaatttcgttattgagacaaatagcgtccggggtagcacatttacattctttaaagattatccatcgagatttaaagcctcaaaatattctcgtttctacttcgagtaggtttactgccgatcagcaaacaggagcagaaaatcttcgaattttgatatcagactttggtctttgcaaaaaactagactctggtcagtcttcatttagaacaaatttgaataacccttctggcacaagtggttggagggccccagagctgcttgaagaatcaaacaatttgcagtgccaagtcgaaacggaacactcttctagtaggcatacagtagtttcatctgattctttttatgatccgttcaccaagaggaggctaacaagatctattgatattttttctatgggatgtgtattctattatatcctatccaaagggaagcatccatttggagataaatattcacgtgaaagcaatatcataagaggaatattcagtcttgatgaaatgaaatgtctacatgatagatccttaattgcagaagctacagatctgatctcccaaatgattgatcacgatccgttaaaaagacctactgctatgaaagttctaaggcatccgttgttttggccaaagtcgaaaaaattggagttccttttaaaagttagtgataggcttgaaattgaaaacagagaccctccaagtgccctgttaatgaaatttgacgccggttctgactttgtaatacccagtggagattggactgtcaagtttgataaaacattcatggacaaccttgaaaggtacagaaaataccattcatcaaagttaatggatctattaagagcacttaggaataaatatcatcattttatggatttacctgaagatatagcagaactaatggggccggtacccgatggattttacgattacttcaccaagcgttttccaaacctattaataggtgtttatatgattgtcaaggaaaatttaagtgacgatcaaattttacgtgaatttttgtattcataa

SEQ ID NO: 296 - protein, 1108 aa, Artificial Sequence
  IRE1 fragment
MLVLTLLVCVFSSIISCSIPLSSRTSRRQIVEDEVASTKKLNFNYGVDKNINSPIPAPRTTEGLPNMKLSSYPTPNLLNTADNRRANKKGRRAANSISVPYLENRSLNELSLSDILIAADVEGGLHAVDRRNGHIIWSIEPENFQPLIEIQEPSRLETYETLIIEPFGDGNIYYFNAHQGLQKLPLSIRQLVSTSPLHLKTNIVVNDSGKIVEDEKVYTGSMRTIMYTINMLNGEIISAFGPGSKNGYFGSQSVDCSPEEKIKLQECENMIVIGKTIFELGIHSYDGASYNVTYSTWQQNVLDVPLALQNTFSKDGMCIAPFRDKSLLASDLDFRIARWVSPTFPGIIVGLFDVFNDLRTNENILVPHPFNPGDHESISSNKVYLDQTSNLSWFALSSQNFPSLVESAPISRYASSDRWRVSSIFEDETLFKNAIMGVHQIYNNEYDHLYENYEKTNSLDTTHKYPPLMIDSSVDTTDLHQNNEMNSLKEYMSPEDLEAYRKKIHEQISRELDEKNQNSLLLKFGSLVYRIIETGVFLLLFLIFCAILQRFKILPPLYVLLSKIGFMPEKEIPIVESKSLNCPSSSENVTKPFDMKSGKQVVFEGAVNDGSLKSEKDNDDADEDDEKSLDLTTEKKKRKRGSRGGKKGRKSRIANIPNFEQSLKNLVVSEKILGYGSSGTVVFQGSFQGRPVAVKRMLIDFCDIALMEIKLLTESDDHPNVIRYYCSETTDRFLYIALELCNLNLQDLVESKNVSDENLKLQKEYNPISLLRQIASGVAHLHSLKIIHRDLKPQNILVSTSSRFTADQQTGAENLRILISDFGLCKKLDSGQSSFRTNLNNPSGTSGWRAPELLEESNNLQCQVETEHSSSRHTVVSSDSFYDPFTKRRLTRSIDIFSMGCVFYYILSKGKHPFGDKYSRESNIIRGIFSLDEMKCLHDRSLIAEATDLISQMIDHDPLKRPTAMKVLRHPLFWPKSKKLEFLLKVSDRLEIENRDPPSALLMKFDAGSDFVIPSGDWTVKFDKTFMDNLERYRKYHSSKLMDLLRALRNKYHHFMDLPEDIAELMGPVPDGFYDYFTKRFPNLLIGVYMIVKENLSDDQILREFLYS

SEQ ID NO: 297 - DNA, 921 bp, Unknown
  Saccharomyces sp.
atgcagttgagcaaggctgctgagatgtgttatgagataacaaactcttacttacacatagaccagaaatctcagataatagcaagtacacaagaagcgatacggttgacaagaaaatacttactaagtgaaatttttgtacgttggagtccactgaatggggaaatatcattctcgtacaacggaggaaaagattgccaggtattactactgttatatctgagttgcttatgggaatatttcttcattaaggctcaaaattcccaattcgatttcgagtttcaaagcttccccatgcaaagacttccaactgttttcattgatcaagaagaaactttccctacattagagaattttgtactggaaacctcagagcgatattgcctttccttatacgaatcacaaaggcaatctggtgcatcggtcaatatggcagacgcatttagagattttataaagatataccctgagaccgaagctatagtgataggtattagacacacagacccatttggtgaagcattaaagcctattcaaagaacagattctaactggcctgattttatgaggttgcaacctctcttacactgggacttaaccaatatatggagtttcttactgtattctaatgagccaatttgtggactatatggtaaaggtttcacatcaatcggcggaattaacaactcattgcctaacccacacttgagaaaggactccaataatccagccttgcattttgaatgggaaatcattcatgcatttggcaaggacgcagaaggcgaacgtagttccgctataaacacgtcacctatttccgtggtggataaggaaagattcagcaaataccatgacaattactatcctggctggtatttggttgatgacactttagagagagcaggcaggatcaagaattaa

SEQ ID NO: 298 - protein, 306 aa, Unknown
  Saccharomyces sp.
MQLSKAAEMCYEITNSYLHIDQKSQIIASTQEAIRLTRKYLLSEIFVRWSPLNGEISFSYNGGKDCQVLLLLYLSCLWEYFFIKAQNSQFDFEFQSFPMQRLPTVFIDQEETFPTLENFVLETSERYCLSLYESQRQSGASVNMADAFRDFIKIYPETEAIVIGIRHTDPFGEALKPIQRTDSNWPDFMRLQPLLHWDLTNIWSFLLYSNEPICGLYGKGFTSIGGINNSLPNPHLRKDSNNPALHFEWEIIHAFGKDAEGERSSAINTSPISVVDKERFSKYHDNYYPGWYLVDDTLERAGRIKN

SEQ ID NO: 299 - DNA, 1635 bp, Artificial Sequence
  CBDA Synthase, I445M variant
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatgtgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 300 - protein, 544 aa, Artificial Sequence
  CBDA Synthase, I445M variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYMCSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 301 - DNA, 1635 bp, Artificial Sequence
  CBDA Synthase, M412Q variant
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtcaatacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 302 - protein, 544 aa, Artificial Sequence
  CBDA Synthase, M412Q variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGQYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 303 - DNA, 1635 bp, Artificial Sequence
  CBDA Synthase, L415M variant
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccatgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 304 - protein, 544 aa, Artificial Sequence
  CBDA Synthase, L415M variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYAMYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 305 - DNA, 1635 bp, Artificial Sequence
  CBDA Synthase, D115N variant
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcataattccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 306 - protein, 544 aa, Artificial Sequence
  CBDA Synthase, D115N variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHNSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 307 - DNA, 1635 bp, Artificial Sequence
  CBDA Synthase, A414T variant
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacactttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 308 - protein, 544 aa, Artificial Sequence
  CBDA Synthase, A414T variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYTLYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 309 - DNA, 1635 bp, Artificial Sequence
  CBDA Synthase, A414V variant
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacgttttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 310 - protein, 544 aa, Artificial Sequence
  CBDA Synthase, A414V variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYVLYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 311 - DNA, 1635 bp, Artificial Sequence
  CBDA Synthase, A414M variant
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaagaagcctattccagaatccgtctttgttcaaattttggagaagttatacgaagaagatattggtgctggtatgtacatgttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 312 - protein, 544 aa, Artificial Sequence
  CBDA Synthase, A414M variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYMLYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 313 - DNA, 1635 bp, Artificial Sequence
  CBDA Synthase, M61W, G378T variant
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatattggtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatactgcctttaaaatcaaattggactacgttaagaagcctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 314 - protein, 544 aa, Artificial Sequence
  CBDA Synthase, M61W, G378T variant
MKCSTFSFWFVCKIIFFFFSFNIQTSIANPRENFLKCFSQYIPNNATNLKLVYTQNNPLYWSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNTAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 315 - DNA, 1635 bp, Artificial Sequence
  CBDA Synthase, M61W, K389E variant
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatattggtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatggtgcctttaaaatcaaattggactacgttaaggaacctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 316 - protein, 544 aa, Artificial Sequence
  CBDA Synthase, M61W, K389E variant
MKCSTFSFWFVCKIIFFFFSFNIQTSIANPRENFLKCFSQYIPNNATNLKLVYTQNNPLYWSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKEPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 317 - DNA, 1635 bp, Artificial Sequence
  CBDA Synthase, G378T, K389E variant
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatatatgtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatactgcctttaaaatcaaattggactacgttaaggaacctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 318 - protein, 544 aa, Artificial Sequence
  CBDA Synthase, G378T, K389E variant
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNTAFKIKLDYVKEPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 319 - DNA, 1635 bp, Artificial Sequence
  CBDA Synthase, M61W, G378T, K389E variant
atgaaatgctccactttctctttctggttcgtttgtaagattatcttcttcttcttttctttcaacatccaaacttccattgccaaccctcgtgagaacttcttgaaatgtttttctcaatatatcccaaataacgctactaacttgaagttagtctatactcaaaacaacccattatattggtctgtcttaaactctaccattcacaacttacgtttcacttctgatactactccaaaacctttggtcatcgtcaccccatcccacgtttctcacatccaaggtaccatcttgtgttccaaaaaggttggtttacaaatccgtactagatccggtggtcatgactccgaaggtatgtcttacatttcccaagtccctttcgtcatcgtcgacttaagaaatatgcgttccatcaagattgatgtccattcccaaactgcttgggttgaagccggtgccactttaggtgaagtctattactgggttaacgagaagaatgagaacttatctttggctgccggttactgtccaactgtttgtgctggtggtcatttcggtggtggtggttacggtccattaatgcgtaactacggtttggctgccgataacatcattgatgcccacttagtcaacgttcatggtaaggtcttggaccgtaagtctatgggtgaggatttattctgggctttgagaggtggtggtgctgaatctttcggtattatcgtcgcttggaagattagattagttgctgttccaaagtctactatgttctctgttaagaagatcatggaaattcacgagttggttaaattagttaacaaatggcaaaacattgcctacaagtacgataaagatttgttattaatgactcactttatcactagaaacattactgataaccaaggtaagaataagactgccattcacacttacttctcttctgttttcttgggtggtgttgattccttggtcgatttgatgaacaagtcttttccagaattaggtattaagaagaccgattgtcgtcaattatcttggattgataccattattttttactccggtgttgtcaactacgacactgataattttaataaggagattttgttagatagatctgctggtcaaaatactgcctttaaaatcaaattggactacgttaaggaacctattccagaatccgtctttgttcaaattttggagaagttatacgaagaagatattggtgctggtatgtacgccttgtatccatatggtggtattatggatgaaatttctgaatccgccatccctttccctcatcgtgctggtatcttatacgagttgtggtacatctgttcttgggaaaagcaagaagataatgaaaagcatttgaactggatccgtaacatctataacttcatgactccatacgtttccaaaaaccctagattggcttacttaaattacagagacttagatattggtattaacgaccctaagaacccaaacaattacactcaagctagaatctggggtgaaaagtacttcggtaagaatttcgacagattagttaaggtcaagactttagttgacccaaataacttcttcagaaacgaacaatctatcccaccattgcctagacatagacactag

SEQ ID NO: 320 - protein, 544 aa, Artificial Sequence
  CBDA Synthase, M61W, G378T, K389E variant
MKCSTFSFWFVCKIIFFFFSFNIQTSIANPRENFLKCFSQYIPNNATNLKLVYTQNNPLYWSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNTAFKIKLDYVKEPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 321 - DNA, 505 bp, Artificial Sequence
  Flanking homology ui12
tcctacaacgatatcattcacttgaaggaatacaaaattgataatgatccaattgaaaagtacgttaagaacagcggcaataatttggggatttgtttctacaaagaataaaaattcatgttcgacatatagatagcagggtaatgtacgtgtatattttaatgtaataaagaggccttactagacggtaaagttaagaatatcgagtgaacttttccttaagataaaggtaaatatagtcgagtatttatttattattcttttccactatacagtatttaaaattctgtaagaaattgattctacatacataagacaaacgaacaggtcagagagaatcagatttttggttagcaagaatacattttggagaagaaagacattaactccaccttactgtatcatcttatttgctttttcactccttcctaatattttttttattttattttgaatttcttcctatttctgatgcattgaacagatcgtaatctgtaagtaaata

SEQ ID NO: 322 - DNA, 476 bp, Artificial Sequence
  Flanking homology di12
aaatcttggctccgttgtgtacaaaacttcttaatgaatatatatatatttttcccttattttatctttttttttcgaattttttatgtaaacattcttatactggaacaatagatggctaatgagtccctataatttcgattttagatgttaacgcttcatttcttttcatataaaagactacctgccaaatgtattttctcctgagtaagtgacatacaaaaacccgtccttatccttgtgttcttgatatatggcagacatcaacgccgcagtaggtggcaaagtatcattgacaaaaatgaagatggccttctcagggggtagcataattctctttcttataacataaacaaattgccctacggtaaggtcagcaggaactagatatttacgcttatcaatctctggaatatctgacttttcagctttttcgcaaatcacaggtatcctattcttgaacctgtcagcaatcc

SEQ ID NO: 323 - DNA, 1030 bp, Unknown
  Saccharomyces sp.
gttaaccattctggttcacttgccgtcgtatgttgcggaccacctattttcgtcgacaccgctagaaatcaaactgccaaagctgttatcagaaacccatcaagaatgattgaatacttggaggaataccaagcctggtgaacaatttttcatatttaagtaaacactcaatgtataatatcctctaactgttgtaatttcattaacgtaaatggtttgcgccttttttaggggacccttgttgattcattctaactactgaggcataagttgtttcaaataacactttttcagaaaaataatcgtattaaaaagcagaaaaatcatacgtaagatgacagaagcttcatatttagtaactctgaattgtataacacaccaattgccgatagaatatgaaccaatcgatcttcagcgttcatgtacttaatttaactacctgtattttcttataaagataaaattggtgtataatgtaagggccaagagaaaaaggaatcccgcatcccaagcaacttctagtggactatttcttcaaaaaaataactgaataaacacctatataatgttcagaggttatactttagtgttttagaatgcagtaccaaaagtaatatattgaattaataactatatgatgtgtagctaagaattaaatagtaaacgtcttctgaaaccttttaagaggtaattattggtattccaaagtcatatgtggaggtaagggagacacaaaattatctggaatgacagcgtgctgacacatataaagttccgtaacttcaaatgccttcattattcaacataggaaaagtgaaatgtgtgcctctaaaatatacggaacatcgtcgaactaaaaaaatccattaagcaaagttagaaacagcatgcactacaagacatttggttcatcatgaagaatgctcaattgaaccatcaatcactttctcttgttcgatgttagcattatcctcactatcagttgaatcctcaatgctttcggtttcagtcctcgcatcttcctgaactt

What is claimed is:

1. An engineered variant of a cannabidiolic acid synthase (CBDAS) polypeptide comprising an amino acid sequence of SEQ ID NO:3 with one or more amino acid substitutions, wherein said one or more amino acid substitutions occurs at an amino acid selected from the group consisting of C12, F17, F18, S20, R31, N33, P43, L49, K50, L51, Q55, N56, N57, L59, M61, S62, V63, S66, L71, S75, 197, L98, S100, V103, T109, Q124, V125, 1129, L132, S137, V149, W161, K165, E167, S170, L171, A172, Y175, C180, A181, H208, A235, A250, M256, K260, L268, H309, T310, F316, L326, G378, K389, E406, M412, L415, S428, L439, 1445, N466, Y499, N527, P538, R541, H542, R543, and H544, and wherein the amino acid sequence has at least 85% sequence identity to SEQ ID NO:3.

2. The engineered variant of claim 1, wherein the engineered variant comprises at least one amino acid substitution at an amino acid selected from the group consisting of L49, K50, N56, N57, V125, L132, V149, W161, K165, S170, L171, A172, N196, A235, K260, L268, T310, F316, L326, G378, S428, Y499, N527, H543, and H544.

3. The engineered variant of claim 1, wherein the engineered variant comprises at least one amino acid substitution at an amino acid selected from the group consisting of N57, S170, A172, N196, A235, K260, and G378.

4. The engineered variant of claim 1, wherein the engineered variant comprises at least one amino acid substitution at an amino acid S170.

5. The engineered variant of claim 1, wherein the engineered variant comprises at least one amino acid substitution selected from the group consisting of L49E, L49Q, K50T, N56E, N57D, V125E, L132M, V149I, W161R, K165A, S170T, L171I, A172V, N196Q, N196T, N196V, A235P, K260W, K260C, L268I, T310A, T310C, F316Y, L326I, G378T, S428L, Y499M, Y499V, N527E, H543E, and H544E.

6. The engineered variant of claim 1, wherein the engineered variant comprises an amino acid substitution S170T.

7. An engineered variant of a cannabidiolic acid synthase (CBDAS) polypeptide comprising the amino acid sequence of SEQ ID NO:3 with one or more amino acid substitutions, wherein the one amino acid substitutions are selected from the group consisting of C12F, F17M, F18T, F18W, S20G, R31Q, N33K, P43E, L49E, L49K, L49Q, K50T, L51I, Q55E, Q55P, N56E, N57D, N57E, L59E, M61H, M61S, M61W, S62N, S62Q, V63M, S66D, L71A, L71H, L71Q, S75D, S75E, 197V, L98V, S100A, V103A, V103F, T109V, Q124D, Q124E, Q124N, V125E, V125Q, I129V, L132M, S137G, H143D, V149I, W161K, W161R, W161Y, K165A, E167P, S170T, L171I, A172V, Y175F, C180A, A181V, N196Q, N196T, N196V, H208T, A235P, A250T, M256V, K260C, K260W, L268I, H309V, T310A, T310C, F316Y, L326I, G378T, G378S, K389E, E406K, M412Q, L415M, S428L, L439M, 1445M, N466D, K474S,-Y499M, Y499V, N527E, P538T, R541E, R541V, H542V, R543A, R543E, H544E, and H544D.

8. The engineered variant of claim 7, wherein the engineered variant comprises an amino acid sequence selected from the group consisting of SEQ ID NO:50, SEQ ID NO: 52, SEQ ID NO:54, SEQ ID NO:56, SEQ ID NO:58, SEQ ID NO:60, SEQ ID NO:62, SEQ ID NO: 64, SEQ ID NO:66, SEQ ID NO:68, SEQ ID NO:70, SEQ ID NO:72, SEQ ID NO:74, SEQ ID NO: 76, SEQ ID NO:78, SEQ ID NO:80, SEQ ID NO:82, SEQ ID NO:84, SEQ ID NO:86, SEQ ID NO: 88, SEQ ID NO:90, SEQ ID NO:92, SEQ ID NO:94, SEQ ID NO:96, SEQ ID NO:98, SEQ ID NO: 100, SEQ ID NO: 102, SEQ ID NO: 104, SEQ ID NO:106, SEQ ID NO:108, SEQ ID NO: 110, SEQ ID NO: 112, SEQ ID NO:114, SEQ ID NO:116, SEQ ID NO: 118, SEQ ID NO:120, SEQ ID NO: 122, SEQ ID NO:124, SEQ ID NO:126, SEQ ID NO:128, SEQ ID NO:130, SEQ ID NO:132, SEQ ID NO: 134, SEQ ID NO:136, SEQ ID NO: 138, SEQ ID NO: 140, SEQ ID NO: 142, SEQ ID NO:144, SEQ ID NO: 146, SEQ ID NO:148, SEQ ID NO: 150, SEQ ID NO: 152, SEQ ID NO: 156, SEQ ID NO:158, SEQ ID NO: 160, SEQ ID NO: 162, SEQ ID NO: 164, SEQ ID NO:166, SEQ ID NO: 168, SEQ ID NO: 170, SEQ ID NO: 172, SEQ ID NO: 174, SEQ ID NO:176, SEQ ID NO: 178, SEQ ID NO:180, SEQ ID NO: 182, SEQ ID NO:184, SEQ ID NO:186, SEQ ID NO: 188, SEQ ID NO: 190, SEQ ID NO:192, SEQ ID NO: 194, SEQ ID NO:196, SEQ ID NO: 198, SEQ ID NO:200, SEQ ID NO:202, SEQ ID NO: 204, SEQ ID NO:206, SEQ ID NO:208, SEQ ID NO:210, SEQ ID NO:212, SEQ ID NO:214, SEQ ID NO: 216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO: 300, SEQ ID NO: 302, and SEQ ID NO: 304.

9. The engineered variant of claim 1, wherein the engineered variant comprises an amino acid sequence of SEQ ID NO:3 with at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, or at least 30 amino acid substitutions.

10. The engineered variant of claim 1, wherein the engineered variant comprises at least one immutable amino acid in a flavin adenine dinucleotide (FAD) binding domain, a berberine bridge enzyme (BBE) domain, or a combination of the foregoing, wherein the immutable amino acid is selected from the group consisting of A28, F34, L35, C37, L64, N70, P87, 193, C99, R108, R110, G112, E117, G118, S120, P126, F127, D131, D141, W148, G152, A153, L155, G156, E157, Y159, Y160, N163, A173, G174, C176, P177, T178, V179, G182, G183, H184, F185, G187, G188, G189, Y190, G191, P192, L193, R195, A201, D202, 1205, D206, V210, G214, G223, D225, L226, F227, W228, R231, G234, S237, F238, G239, K245, 1246, L248, V251, V259, Q276, F312, S313, L323, C341, F352, S354, F380, K381, 1382, K383, D385, Y386, 1391, G419, M422, 1425, 1430, P431, P433, H434, R435, G437, Y440, W443, Y444, 1464, Y465, M468, T469, Y471, V472, P476, R484, N498, A502, N513, F514, K521, N528, F529, E533, Q534, and S535.

11. The engineered variant of claim 10, wherein the engineered variant comprises at least 1, at least 2, at least 3, at least 4, at least 5, at least 6, at least 7, at least 8, at least 9, at least 10, at least 11, at least 12, at least 13, at least 14, or at least 15 immutable amino acids in the FAD binding domain, the BBE domain, or a combination of the foregoing.

12. The engineered variant of claim 1, wherein the engineered variant comprises at least one immutable amino acid selected from the group consisting of A28, F34, L35, C37, L64, N70, P87, 193, C99, R108, R110, G112, E117, G118, S120, P126, F127, D131, D141, W148, G152, A153, L155, G156, E157, Y159, Y160, N163, A173, G174, C176, P177, T178, V179, G182, G183, H184, F185, G187, G188, G189, Y190, G191, P192, L193, R195, A201, D202, I205, D206, V210, G214, G223, D225, L226, F227, W228, R231, G234, S237, F238, G239, K245, I246, L248, V251, V259, Q276, F312, S313, L323, C341, F352, S354, F380, K381, 1382, K383, D385, Y386, 1391, G419, M422, 1425, 1430, P431, P433, H434, R435, G437, Y440, W443, Y444, 1464, Y465, M468, T469, Y471, V472, P476, R484, N498, A502, N513, F514, K521, N528, F529, E533, Q534, and S535.

13. The engineered variant of claim 1, wherein the engineered variant comprises at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, or at least 25 immutable amino acids, wherein the immutable amino acids are selected from the group consisting of A28, F34, L35, C37, L64, N70, P87, 193, C99, R108, R110, G112, E117, G118, S120, P126, F127, D131, D141, W148, G152, A153, L155, G156, E157, Y159, Y160, N163, A173, G174, C176, P177, T178, V179, G182, G183, H184, F185, G187, G188, G189, Y190, G191, P192, L193, R195, A201, D202, 1205, D206, V210, G214, G223, D225, L226, F227, W228, R231, G234, S237, F238, G239, K245, 1246, L248, V251, V259, Q276, F312, S313, L323, C341, F352, S354, F380, K381, 1382, K383, D385, Y386, 1391, G419, M422, 1425, 1430, P431, P433, H434, R435, G437, Y440, W443, Y444, 1464, Y465, M468, T469, Y471, V472, P476, R484, N498, A502, N513, F514, K521, N528, F529, E533, Q534, and S535.

14. The engineered variant of claim 1, wherein the engineered variant produces cannabidiolic acid (CBDA) from cannabigerolic acid (CBGA) in a greater amount, as measured in mg/L or mM, than an amount of CBDA produced from CBGA by a cannabidiolic acid synthase polypeptide having an amino acid sequence of SEQ ID NO:3 under similar conditions for the same length of time.

15. The engineered variant of claim 14, wherein the engineered variant produces cannabidiolic acid (CBDA) from cannabigerolic acid (CBGA) in an amount, as measured in mg/L or mM, at least 5%, at least 10%, at least 15%, at least 20%, at least 25%, at least 30%, at least 35%, at least 40%, at least 45%, at least 50%, at least 60%, at least 70%, at least 80%, at least 90%, at least 100%, at least 150% at least 200%, at least 500%, or at least 1000% greater than an amount of CBDA produced from CBGA by a cannabidiolic acid synthase polypeptide having an amino acid sequence of SEQ ID NO:3 under similar conditions for the same length of time.

16. The engineered variant of claim 1, wherein the engineered variant produces cannabidiolic acid (CBDA) from cannabigerolic acid (CBGA) in an increased ratio of CBDA over tetrahydrocannabinolic acid (THCA) compared to that produced by a cannabidiolic acid synthase polypeptide having an amino acid sequence of SEQ ID NO:3 under similar conditions for the same length of time.

17. The engineered variant of claim 16, wherein the engineered variant produces CBDA from CBGA in a ratio of CBDA over THCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

18. The engineered variant of claim 1, wherein the engineered variant produces cannabidiolic acid (CBDA) from cannabigerolic acid (CBGA) in an increased ratio of CBDA over cannabichromenic acid (CBCA) compared to that produced by a cannabidiolic acid synthase polypeptide having an amino acid sequence of SEQ ID NO:3 under similar conditions for the same length of time.

19. The engineered variant of claim 18, wherein the engineered variant produces CBDA from CBGA in a ratio of CBDA over CBCA of about 11:1, about 11.5:1, about 12:1, about 12.5:1, about 13:1, about 13.5:1, about 14:1, about 14.5:1, about 15:1, about 15.5:1, about 16:1, about 16.5:1, about 17:1, about 17.5:1, about 18:1, about 18.5:1, about 19:1, about 19.5:1, about 20:1, about 25:1, about 30:1, about 35:1, about 40:1, about 45:1, about 50:1, about 60:1, about 70:1, about 80:1, about 90:1, about 100:1, about 150:1, about 200:1, about 500:1, or greater than about 500:1.

20. A nucleic acid comprising a nucleotide sequence encoding an engineered variant of claim 1.

21. A method of making a modified yeast host cell for producing a cannabinoid or a cannabinoid derivative, the method comprising introducing one or more nucleic acids of claim 20 into a host yeast cell.

22. A vector comprising one or more nucleic acids of claim 20.

23. A method of making a modified yeast host cell for producing a cannabinoid or a cannabinoid derivative, the method comprising introducing one or more vectors of claim 22 into a host yeast cell.

24. A modified yeast host cell for producing a cannabinoid or a cannabinoid derivative, wherein the modified host cell comprises one or more nucleic acids of claim 20.

25. The modified yeast host cell of claim 24, wherein the modified host cell comprises one or more heterologous nucleic acids comprising a nucleotide sequence encoding:

a) a geranyl pyrophosphate: olivetolic acid geranyltransferase (GOT) polypeptide;

b) two to twelve copies of a tetraketide synthase (TKS) polypeptide;

c) two to twelve copies of an olivetolic acid (OAC) polypeptide; and d) one to eight copies of an acyl-activating enzyme (AAE) polypeptide, wherein at least one of the one or more nucleic acids are integrated into the chromosome of the modified yeast host cell; and wherein at least one of the one or more nucleic acids are operably-linked to an inducible promoter or a constitutive promoter.

26. The modified yeast host cell of claim 24, wherein the yeast host cell is *Saccharomyces cerevisiae*.

27. A method of producing a cannabinoid or a cannabinoid derivative, the method comprising:

a) culturing a modified yeast host cell of claim 24 in a culture medium.

* * * * *